United States Patent 8,673,560 (METHODS AND COMPOSITIONS FOR MULTIPLEX PCR) - sequence listing, part 4

SEQ ID NO: 98327 - DNA, 20 bp, Artificial Sequence
  Synthetic
cactctcuggccaatgccut

SEQ ID NO: 98328 - DNA, 20 bp, Artificial Sequence
  Synthetic
caggcagacacuggcaguag

SEQ ID NO: 98329 - DNA, 21 bp, Artificial Sequence
  Synthetic
accauggaacctgtacuccca

SEQ ID NO: 98330 - DNA, 24 bp, Artificial Sequence
  Synthetic
gattgcugggaagggtaaggaaut

SEQ ID NO: 98331 - DNA, 23 bp, Artificial Sequence
  Synthetic
ccatctagcaugccatcauccat

SEQ ID NO: 98332 - DNA, 21 bp, Artificial Sequence
  Synthetic
cacagtggaaucctccaggut

SEQ ID NO: 98333 - DNA, 25 bp, Artificial Sequence
  Synthetic
tggttccctguctaatcctcttugt

SEQ ID NO: 98334 - DNA, 20 bp, Artificial Sequence
  Synthetic
cccaggugttggatgucaac

SEQ ID NO: 98335 - DNA, 28 bp, Artificial Sequence
  Synthetic
gagacaagtaaauccccctgauaaacat

SEQ ID NO: 98336 - DNA, 20 bp, Artificial Sequence
  Synthetic
ggacaugggtcacucaggca

SEQ ID NO: 98337 - DNA, 21 bp, Artificial Sequence
  Synthetic
ctgcaagtguctcccagguaa

SEQ ID NO: 98338 - DNA, 23 bp, Artificial Sequence
  Synthetic
ctcacatgcagutctaccaccuc

SEQ ID NO: 98339 - DNA, 23 bp, Artificial Sequence
  Synthetic
gatcatgatguctgcctcuccat

SEQ ID NO: 98340 - DNA, 18 bp, Artificial Sequence
  Synthetic
ctgucccccacagtgugt

SEQ ID NO: 98341 - DNA, 19 bp, Artificial Sequence
  Synthetic
tcctcuccccacccactuc

SEQ ID NO: 98342 - DNA, 24 bp, Artificial Sequence
  Synthetic
gggtgtccucatggttctaatuca

SEQ ID NO: 98343 - DNA, 20 bp, Artificial Sequence
  Synthetic
ctgctcacugccacaguagg

SEQ ID NO: 98344 - DNA, 22 bp, Artificial Sequence
  Synthetic
ccaugaaagagtucgccgagaa

SEQ ID NO: 98345 - DNA, 20 bp, Artificial Sequence
  Synthetic
ctcgatgtcugcgagtcucc

SEQ ID NO: 98346 - DNA, 20 bp, Artificial Sequence
  Synthetic
caccgagaagcucaccaugt

SEQ ID NO: 98347 - DNA, 25 bp, Artificial Sequence
  Synthetic
ccctaagugccagtatgctgauaag

SEQ ID NO: 98348 - DNA, 22 bp, Artificial Sequence
  Synthetic
actgcggutttctcgaauccat

SEQ ID NO: 98349 - DNA, 21 bp, Artificial Sequence
  Synthetic
tgtcctatcuaagccgcccut

SEQ ID NO: 98350 - DNA, 24 bp, Artificial Sequence
  Synthetic
aagggcaaaagaaccutccacuaa

SEQ ID NO: 98351 - DNA, 21 bp, Artificial Sequence
  Synthetic
accgccagaucaccatctuac

SEQ ID NO: 98352 - DNA, 28 bp, Artificial Sequence
  Synthetic
tgttatttgttguttttcccctgugaac

SEQ ID NO: 98353 - DNA, 25 bp, Artificial Sequence
  Synthetic
tcacacctctugagatcagagauca

SEQ ID NO: 98354 - DNA, 20 bp, Artificial Sequence
  Synthetic
gcctucccggacacagtuaa

SEQ ID NO: 98355 - DNA, 20 bp, Artificial Sequence
  Synthetic
cgagucgaguacgccaagag

SEQ ID NO: 98356 - DNA, 22 bp, Artificial Sequence
  Synthetic
gatgctcucgctgcatttctug

SEQ ID NO: 98357 - DNA, 20 bp, Artificial Sequence
  Synthetic
cagcgtgtutctaggtcgug

SEQ ID NO: 98358 - DNA, 22 bp, Artificial Sequence
  Synthetic
acugggacucgaacacaagaac

SEQ ID NO: 98359 - DNA, 23 bp, Artificial Sequence
  Synthetic
gcctggaucacttcaattgctuc

SEQ ID NO: 98360 - DNA, 22 bp, Artificial Sequence
  Synthetic
cctgagacaaaugggcuacacc

SEQ ID NO: 98361 - DNA, 27 bp, Artificial Sequence
  Synthetic
agctggaaaatauctccactgtcttut

SEQ ID NO: 98362 - DNA, 23 bp, Artificial Sequence
  Synthetic
tctaaagcucctcccucacacat

SEQ ID NO: 98363 - DNA, 25 bp, Artificial Sequence
  Synthetic
catccagcaccauaatcctcttcug

SEQ ID NO: 98364 - DNA, 23 bp, Artificial Sequence
  Synthetic
gggatgagaucaatgccattcug

SEQ ID NO: 98365 - DNA, 25 bp, Artificial Sequence
  Synthetic
ggcctggcaugatctttaaatucct

SEQ ID NO: 98366 - DNA, 22 bp, Artificial Sequence
  Synthetic
aacgaagaacacutccgagguc

SEQ ID NO: 98367 - DNA, 25 bp, Artificial Sequence
  Synthetic
acatgggaaccugggaatacttuac

SEQ ID NO: 98368 - DNA, 26 bp, Artificial Sequence
  Synthetic
ctgatgtgcugggtgtgatttattut

SEQ ID NO: 98369 - DNA, 21 bp, Artificial Sequence
  Synthetic
accccagccutgtctgtttut

SEQ ID NO: 98370 - DNA, 26 bp, Artificial Sequence
  Synthetic
gtttctcaggcuccagttctatctuc

SEQ ID NO: 98371 - DNA, 22 bp, Artificial Sequence
  Synthetic
cctcccuccttctgtuccaaaa

SEQ ID NO: 98372 - DNA, 17 bp, Artificial Sequence
  Synthetic
gaggccuggatguggca

SEQ ID NO: 98373 - DNA, 19 bp, Artificial Sequence
  Synthetic
cccagcuctccctcuccat

SEQ ID NO: 98374 - DNA, 20 bp, Artificial Sequence
  Synthetic
gcacaagaagcugggtguca

SEQ ID NO: 98375 - DNA, 18 bp, Artificial Sequence
  Synthetic
cctggcutcctgggugag

SEQ ID NO: 98376 - DNA, 27 bp, Artificial Sequence
  Synthetic
gaacatcutcctaaactucaacccaga

SEQ ID NO: 98377 - DNA, 28 bp, Artificial Sequence
  Synthetic
tccataaagcagguaagttttcacugaa

SEQ ID NO: 98378 - DNA, 26 bp, Artificial Sequence
  Synthetic
tgtggttttgautctcagatggtugt

SEQ ID NO: 98379 - DNA, 21 bp, Artificial Sequence
  Synthetic
tctctgcaaccutccactguc

SEQ ID NO: 98380 - DNA, 21 bp, Artificial Sequence
  Synthetic
cgttggtuaccttggcucagt

SEQ ID NO: 98381 - DNA, 21 bp, Artificial Sequence
  Synthetic
caccccucagactctgaugga

SEQ ID NO: 98382 - DNA, 20 bp, Artificial Sequence
  Synthetic
cagggctuctgggcacauaa

SEQ ID NO: 98383 - DNA, 24 bp, Artificial Sequence
  Synthetic
ggccatucaggagaaggttttuga

SEQ ID NO: 98384 - DNA, 21 bp, Artificial Sequence
  Synthetic
gcatctcccuggcttacugac

SEQ ID NO: 98385 - DNA, 24 bp, Artificial Sequence
  Synthetic
ggauaaagaagcccugaagaagca

SEQ ID NO: 98386 - DNA, 27 bp, Artificial Sequence
  Synthetic
actgaatgtucaaatgcagagauggat

SEQ ID NO: 98387 - DNA, 24 bp, Artificial Sequence
  Synthetic
gctccaaaattuccatctgggugt

SEQ ID NO: 98388 - DNA, 27 bp, Artificial Sequence
  Synthetic
tccactuagagagaaacuccaagaaca

SEQ ID NO: 98389 - DNA, 28 bp, Artificial Sequence
  Synthetic
ctcagtggttgaguacaatactggaaut

SEQ ID NO: 98390 - DNA, 21 bp, Artificial Sequence
  Synthetic
cacccacccutcactctugac

SEQ ID NO: 98391 - DNA, 22 bp, Artificial Sequence
  Synthetic
catgatugaccgctgguaccat

SEQ ID NO: 98392 - DNA, 22 bp, Artificial Sequence
  Synthetic
ccugttctugacaaagcagcct

SEQ ID NO: 98393 - DNA, 20 bp, Artificial Sequence
  Synthetic
gctgcccguatcatgtucac

SEQ ID NO: 98394 - DNA, 26 bp, Artificial Sequence
  Synthetic
gcucaaagttctttauggagacacct

SEQ ID NO: 98395 - DNA, 23 bp, Artificial Sequence
  Synthetic
cagcttcauaaccgaagatugct

SEQ ID NO: 98396 - DNA, 20 bp, Artificial Sequence
  Synthetic
ccagcaaagutggtggucct

SEQ ID NO: 98397 - DNA, 27 bp, Artificial Sequence
  Synthetic
tgtctttcagucaaccagaguaacaaa

SEQ ID NO: 98398 - DNA, 23 bp, Artificial Sequence
  Synthetic
caaagagagacccutgacggaua

SEQ ID NO: 98399 - DNA, 21 bp, Artificial Sequence
  Synthetic
tgctgtgaacucctctgctuc

SEQ ID NO: 98400 - DNA, 21 bp, Artificial Sequence
  Synthetic
gtcccaaaugctgtaccugct

SEQ ID NO: 98401 - DNA, 27 bp, Artificial Sequence
  Synthetic
ggaattccgagaaauctcttaccucaa

SEQ ID NO: 98402 - DNA, 18 bp, Artificial Sequence
  Synthetic
ggaggcgcuggtttcugg

SEQ ID NO: 98403 - DNA, 20 bp, Artificial Sequence
  Synthetic
tcaagggagagcuggctuct

SEQ ID NO: 98404 - DNA, 23 bp, Artificial Sequence
  Synthetic
tgcagcaaacutgtctctuacct

SEQ ID NO: 98405 - DNA, 28 bp, Artificial Sequence
  Synthetic
gtgtttttgucatcacttttgucacaac

SEQ ID NO: 98406 - DNA, 27 bp, Artificial Sequence
  Synthetic
acactgaatcuaaaaaggacccugaag

SEQ ID NO: 98407 - DNA, 26 bp, Artificial Sequence
  Synthetic
cttcttttgttccugttgcatacgut

SEQ ID NO: 98408 - DNA, 21 bp, Artificial Sequence
  Synthetic
tgggaatggugaggtcacuct

SEQ ID NO: 98409 - DNA, 26 bp, Artificial Sequence
  Synthetic
agatatctttcugcacctaggacuga

SEQ ID NO: 98410 - DNA, 21 bp, Artificial Sequence
  Synthetic
ctgctggtucactgtgtcugt

SEQ ID NO: 98411 - DNA, 22 bp, Artificial Sequence
  Synthetic
ccuagaaagcggagacagucct

SEQ ID NO: 98412 - DNA, 28 bp, Artificial Sequence
  Synthetic
tgatggtagtugaataaaagtgcttuga

SEQ ID NO: 98413 - DNA, 20 bp, Artificial Sequence
  Synthetic
gcugcacccaaagcacaaut

SEQ ID NO: 98414 - DNA, 26 bp, Artificial Sequence
  Synthetic
agcattggatuaaattgtgcttuggg

SEQ ID NO: 98415 - DNA, 27 bp, Artificial Sequence
  Synthetic
tctcttacctcauctatgccatgtcut

SEQ ID NO: 98416 - DNA, 23 bp, Artificial Sequence
  Synthetic
tcctatctgcucagatgggcuat

SEQ ID NO: 98417 - DNA, 22 bp, Artificial Sequence
  Synthetic
aagttggtguacggtccaaucc

SEQ ID NO: 98418 - DNA, 25 bp, Artificial Sequence
  Synthetic
tccttttaagguctagagccctuca

SEQ ID NO: 98419 - DNA, 22 bp, Artificial Sequence
  Synthetic
cuagccaaagacaugggcagat

SEQ ID NO: 98420 - DNA, 27 bp, Artificial Sequence
  Synthetic
agcattgttugatggttattttuggca

SEQ ID NO: 98421 - DNA, 28 bp, Artificial Sequence
  Synthetic
tcttttgacuaatcagtgtgtucagcat

SEQ ID NO: 98422 - DNA, 22 bp, Artificial Sequence
  Synthetic
gguctacgatgaugcccacaat

SEQ ID NO: 98423 - DNA, 22 bp, Artificial Sequence
  Synthetic
cctctgcguacaggtgaatguc

SEQ ID NO: 98424 - DNA, 22 bp, Artificial Sequence
  Synthetic
gccagcacagaguauccaagac

SEQ ID NO: 98425 - DNA, 21 bp, Artificial Sequence
  Synthetic
gctggctgucagtacacctuc

SEQ ID NO: 98426 - DNA, 22 bp, Artificial Sequence
  Synthetic
gggcaagagutguccacagaat

SEQ ID NO: 98427 - DNA, 23 bp, Artificial Sequence
  Synthetic
gtcagagacucggtaaagcugag

SEQ ID NO: 98428 - DNA, 21 bp, Artificial Sequence
  Synthetic
gtggagacaucctuccgcaaa

SEQ ID NO: 98429 - DNA, 21 bp, Artificial Sequence
  Synthetic
cacggtgugggaaattgucag

SEQ ID NO: 98430 - DNA, 26 bp, Artificial Sequence
  Synthetic
agagttgtauaggaactgtcagugct

SEQ ID NO: 98431 - DNA, 27 bp, Artificial Sequence
  Synthetic
tggaataaaatguaaggtcacccacut

SEQ ID NO: 98432 - DNA, 20 bp, Artificial Sequence
  Synthetic
ccatgcugccccagtatgua

SEQ ID NO: 98433 - DNA, 22 bp, Artificial Sequence
  Synthetic
acttctccugcttcuggaaggt

SEQ ID NO: 98434 - DNA, 20 bp, Artificial Sequence
  Synthetic
cccatccaccucaacgucag

SEQ ID NO: 98435 - DNA, 24 bp, Artificial Sequence
  Synthetic
caaggtcaagguctagtgggtcua

SEQ ID NO: 98436 - DNA, 17 bp, Artificial Sequence
  Synthetic
guccgcaccccttucct

SEQ ID NO: 98437 - DNA, 19 bp, Artificial Sequence
  Synthetic
gggaggcuccggttacuca

SEQ ID NO: 98438 - DNA, 21 bp, Artificial Sequence
  Synthetic
gcattguccctgtugcacaaa

SEQ ID NO: 98439 - DNA, 21 bp, Artificial Sequence
  Synthetic
tcccggaacaaggaugaagug

SEQ ID NO: 98440 - DNA, 23 bp, Artificial Sequence
  Synthetic
ccgagtttcucaatcatggccut

SEQ ID NO: 98441 - DNA, 22 bp, Artificial Sequence
  Synthetic
gctggcctugctgaatgatuct

SEQ ID NO: 98442 - DNA, 20 bp, Artificial Sequence
  Synthetic
agacccccucctccaguaac

SEQ ID NO: 98443 - DNA, 23 bp, Artificial Sequence
  Synthetic
tcacctcgagaguacagcgttua

SEQ ID NO: 98444 - DNA, 23 bp, Artificial Sequence
  Synthetic
ggagattuttggtgcugaaccca

SEQ ID NO: 98445 - DNA, 25 bp, Artificial Sequence
  Synthetic
aggagaggaaaagugtgucaagaag

SEQ ID NO: 98446 - DNA, 28 bp, Artificial Sequence
  Synthetic
ttggacatgtttucacagtagttguaga

SEQ ID NO: 98447 - DNA, 27 bp, Artificial Sequence
  Synthetic
tctutctctagtccauagccaaacaga

SEQ ID NO: 98448 - DNA, 26 bp, Artificial Sequence
  Synthetic
tgtctatggcaugttagaacaagugt

SEQ ID NO: 98449 - DNA, 28 bp, Artificial Sequence
  Synthetic
aaggcattattaaguatccccagaccua

SEQ ID NO: 98450 - DNA, 28 bp, Artificial Sequence
  Synthetic
caaacttaattggcutaacgttcaccut

SEQ ID NO: 98451 - DNA, 28 bp, Artificial Sequence
  Synthetic
caaatagaaggagagcuaccacaaacut

SEQ ID NO: 98452 - DNA, 20 bp, Artificial Sequence
  Synthetic
ggcuactcuggcgcagaaat

SEQ ID NO: 98453 - DNA, 28 bp, Artificial Sequence
  Synthetic
gccagagatgutaacagagtaaagucaa

SEQ ID NO: 98454 - DNA, 21 bp, Artificial Sequence
  Synthetic
gctggcagucctgtttgctua

SEQ ID NO: 98455 - DNA, 28 bp, Artificial Sequence
  Synthetic
ccttctacctuccccttactttttagut

SEQ ID NO: 98456 - DNA, 20 bp, Artificial Sequence
  Synthetic
ccacccugacttgtctguct

SEQ ID NO: 98457 - DNA, 18 bp, Artificial Sequence
  Synthetic
gaccuggccaccauggaa

SEQ ID NO: 98458 - DNA, 17 bp, Artificial Sequence
  Synthetic
tuccaccauccgcagca

SEQ ID NO: 98459 - DNA, 21 bp, Artificial Sequence
  Synthetic
ggtcagctuggtgaagaggut

SEQ ID NO: 98460 - DNA, 18 bp, Artificial Sequence
  Synthetic
cccacacuggcccaugag

SEQ ID NO: 98461 - DNA, 21 bp, Artificial Sequence
  Synthetic
gagcagaguggaagacaggut

SEQ ID NO: 98462 - DNA, 23 bp, Artificial Sequence
  Synthetic
agcaatctgcccutttctgtcut

SEQ ID NO: 98463 - DNA, 20 bp, Artificial Sequence
  Synthetic
ctcacaggcuccacactcug

SEQ ID NO: 98464 - DNA, 20 bp, Artificial Sequence
  Synthetic
cgaauagccaggcugacaca

SEQ ID NO: 98465 - DNA, 21 bp, Artificial Sequence
  Synthetic
gaggactgcuaggagctucaa

SEQ ID NO: 98466 - DNA, 21 bp, Artificial Sequence
  Synthetic
actgcugaccagtgaatcucc

SEQ ID NO: 98467 - DNA, 22 bp, Artificial Sequence
  Synthetic
gcagcuaggugcaaaacagagt

SEQ ID NO: 98468 - DNA, 19 bp, Artificial Sequence
  Synthetic
cttctggaccgcutgggua

SEQ ID NO: 98469 - DNA, 26 bp, Artificial Sequence
  Synthetic
acaccaatgatgugtgattgtctcut

SEQ ID NO: 98470 - DNA, 26 bp, Artificial Sequence
  Synthetic
agcttgacaaccutttagtgauccat

SEQ ID NO: 98471 - DNA, 25 bp, Artificial Sequence
  Synthetic
atgttgtctugcacatactttgcug

SEQ ID NO: 98472 - DNA, 23 bp, Artificial Sequence
  Synthetic
ttctcaagagaugctcctgtugg

SEQ ID NO: 98473 - DNA, 20 bp, Artificial Sequence
  Synthetic
cuacccgactuaggcacgat

SEQ ID NO: 98474 - DNA, 19 bp, Artificial Sequence
  Synthetic
cctccuaagggagcugggt

SEQ ID NO: 98475 - DNA, 18 bp, Artificial Sequence
  Synthetic
aggguccctgccugaaga

SEQ ID NO: 98476 - DNA, 20 bp, Artificial Sequence
  Synthetic
cctgggcaugaatggacugt

SEQ ID NO: 98477 - DNA, 23 bp, Artificial Sequence
  Synthetic
agtgctauccggaagaaaagcug

SEQ ID NO: 98478 - DNA, 22 bp, Artificial Sequence
  Synthetic
gcccauggaagcatgtctcaut

SEQ ID NO: 98479 - DNA, 22 bp, Artificial Sequence
  Synthetic
gtcataggaugtgcccuggaag

SEQ ID NO: 98480 - DNA, 20 bp, Artificial Sequence
  Synthetic
aaggacagcccugcaagtut

SEQ ID NO: 98481 - DNA, 22 bp, Artificial Sequence
  Synthetic
cagggcagaagccauacttcut

SEQ ID NO: 98482 - DNA, 20 bp, Artificial Sequence
  Synthetic
cgtggugcggctcatgttua

SEQ ID NO: 98483 - DNA, 20 bp, Artificial Sequence
  Synthetic
gcccccugttggaagugaag

SEQ ID NO: 98484 - DNA, 24 bp, Artificial Sequence
  Synthetic
acaagugaagccagattcccuaga

SEQ ID NO: 98485 - DNA, 22 bp, Artificial Sequence
  Synthetic
cccttauacacgcctctgucat

SEQ ID NO: 98486 - DNA, 20 bp, Artificial Sequence
  Synthetic
gcaccacugaggacuacgac

SEQ ID NO: 98487 - DNA, 22 bp, Artificial Sequence
  Synthetic
agatgtctuagcacccctguct

SEQ ID NO: 98488 - DNA, 23 bp, Artificial Sequence
  Synthetic
gaatgtgucccgaatugggaaga

SEQ ID NO: 98489 - DNA, 21 bp, Artificial Sequence
  Synthetic
ggttuccgtttgaucccaagg

SEQ ID NO: 98490 - DNA, 20 bp, Artificial Sequence
  Synthetic
ctcgccucagttgccatcua

SEQ ID NO: 98491 - DNA, 17 bp, Artificial Sequence
  Synthetic
caggaacggcuguggct

SEQ ID NO: 98492 - DNA, 18 bp, Artificial Sequence
  Synthetic
ccctccugaggcccugat

SEQ ID NO: 98493 - DNA, 19 bp, Artificial Sequence
  Synthetic
gctggcagaccuccactuc

SEQ ID NO: 98494 - DNA, 17 bp, Artificial Sequence
  Synthetic
gagccccugtcccacut

SEQ ID NO: 98495 - DNA, 17 bp, Artificial Sequence
  Synthetic
ggaccguggtggcucag

SEQ ID NO: 98496 - DNA, 18 bp, Artificial Sequence
  Synthetic
cacccgcaucuccaacga

SEQ ID NO: 98497 - DNA, 21 bp, Artificial Sequence
  Synthetic
ggacaaucttugcccccaaat

SEQ ID NO: 98498 - DNA, 25 bp, Artificial Sequence
  Synthetic
aguatttgaaacacuggaagcacga

SEQ ID NO: 98499 - DNA, 24 bp, Artificial Sequence
  Synthetic
caaggccaggaaaaugatgctuac

SEQ ID NO: 98500 - DNA, 22 bp, Artificial Sequence
  Synthetic
ggttccttcugacacctgtcut

SEQ ID NO: 98501 - DNA, 19 bp, Artificial Sequence
  Synthetic
caggatggcuctcccugac

SEQ ID NO: 98502 - DNA, 18 bp, Artificial Sequence
  Synthetic
gggcacgcutacugacac

SEQ ID NO: 98503 - DNA, 19 bp, Artificial Sequence
  Synthetic
gacgtcgcucaccaacgua

SEQ ID NO: 98504 - DNA, 19 bp, Artificial Sequence
  Synthetic
gtcagcagaucccaguggt

SEQ ID NO: 98505 - DNA, 18 bp, Artificial Sequence
  Synthetic
ggcccuggctcttctgua

SEQ ID NO: 98506 - DNA, 23 bp, Artificial Sequence
  Synthetic
aauccagacagcagaatgucgaa

SEQ ID NO: 98507 - DNA, 26 bp, Artificial Sequence
  Synthetic
tctctcatatccugtgtctcctucag

SEQ ID NO: 98508 - DNA, 23 bp, Artificial Sequence
  Synthetic
tcagtgaaggutgatttgcccut

SEQ ID NO: 98509 - DNA, 22 bp, Artificial Sequence
  Synthetic
tctacccacccautccttucca

SEQ ID NO: 98510 - DNA, 21 bp, Artificial Sequence
  Synthetic
tcagucccagagccaggttua

SEQ ID NO: 98511 - DNA, 21 bp, Artificial Sequence
  Synthetic
ctccctttuccgacctuccag

SEQ ID NO: 98512 - DNA, 26 bp, Artificial Sequence
  Synthetic
tcccttcgaugtataacgatttcugg

SEQ ID NO: 98513 - DNA, 28 bp, Artificial Sequence
  Synthetic
ctccctttaaaugacagtgtggagauaa

SEQ ID NO: 98514 - DNA, 21 bp, Artificial Sequence
  Synthetic
ggagattgccucaagctgcua

SEQ ID NO: 98515 - DNA, 24 bp, Artificial Sequence
  Synthetic
attttcccaagagucatccagguc

SEQ ID NO: 98516 - DNA, 22 bp, Artificial Sequence
  Synthetic
caaagauggcaaactugcccat

SEQ ID NO: 98517 - DNA, 26 bp, Artificial Sequence
  Synthetic
ggcatcattuatttcatctcgugcaa

SEQ ID NO: 98518 - DNA, 23 bp, Artificial Sequence
  Synthetic
acattatggucaccatgggctut

SEQ ID NO: 98519 - DNA, 27 bp, Artificial Sequence
  Synthetic
aggtgaaaaactuacttcaggtggtut

SEQ ID NO: 98520 - DNA, 28 bp, Artificial Sequence
  Synthetic
gcacgagatgaaauaaatgatgcctuaa

SEQ ID NO: 98521 - DNA, 33 bp, Artificial Sequence
  Synthetic
tattagctcaagaaauaattcacagtaatcuga

SEQ ID NO: 98522 - DNA, 27 bp, Artificial Sequence
  Synthetic
tctgtggattttuctcaaagtcagcut

SEQ ID NO: 98523 - DNA, 28 bp, Artificial Sequence
  Synthetic
ggtcctttcacagacauatgtattccut

SEQ ID NO: 98524 - DNA, 19 bp, Artificial Sequence
  Synthetic
ggtgggaagccuggctuag

SEQ ID NO: 98525 - DNA, 20 bp, Artificial Sequence
  Synthetic
cutgauggagagcgggaaga

SEQ ID NO: 98526 - DNA, 22 bp, Artificial Sequence
  Synthetic
attctggagguagcauggcaag

SEQ ID NO: 98527 - DNA, 21 bp, Artificial Sequence
  Synthetic
tucagcaagggcacuaacaca

SEQ ID NO: 98528 - DNA, 20 bp, Artificial Sequence
  Synthetic
cgtccttccucctcctcuca

SEQ ID NO: 98529 - DNA, 19 bp, Artificial Sequence
  Synthetic
ctcggtgcuggcttctcut

SEQ ID NO: 98530 - DNA, 18 bp, Artificial Sequence
  Synthetic
gtcacacugtggguggca

SEQ ID NO: 98531 - DNA, 18 bp, Artificial Sequence
  Synthetic
gggugugagggcagaagt

SEQ ID NO: 98532 - DNA, 17 bp, Artificial Sequence
  Synthetic
caucgcaggccccauct

SEQ ID NO: 98533 - DNA, 21 bp, Artificial Sequence
  Synthetic
cctcccuccccatgcctauac

SEQ ID NO: 98534 - DNA, 20 bp, Artificial Sequence
  Synthetic
gtctcugagcagctgccaut

SEQ ID NO: 98535 - DNA, 18 bp, Artificial Sequence
  Synthetic
caucacugccaccacgga

SEQ ID NO: 98536 - DNA, 24 bp, Artificial Sequence
  Synthetic
gtggagaactutgagcctctcuat

SEQ ID NO: 98537 - DNA, 22 bp, Artificial Sequence
  Synthetic
attcctgaaccuctgacuccct

SEQ ID NO: 98538 - DNA, 18 bp, Artificial Sequence
  Synthetic
ccagggagcgcuacgaug

SEQ ID NO: 98539 - DNA, 22 bp, Artificial Sequence
  Synthetic
ctgccaacuctttgtccgttut

SEQ ID NO: 98540 - DNA, 20 bp, Artificial Sequence
  Synthetic
ccgtcgcccaucatcaagut

SEQ ID NO: 98541 - DNA, 21 bp, Artificial Sequence
  Synthetic
gagagacacccccauccttug

SEQ ID NO: 98542 - DNA, 23 bp, Artificial Sequence
  Synthetic
tcctgatacccuctacccccaua

SEQ ID NO: 98543 - DNA, 21 bp, Artificial Sequence
  Synthetic
ggtagcttucactgcgtgugt

SEQ ID NO: 98544 - DNA, 29 bp, Artificial Sequence
  Synthetic
cccataccttcaaauattagagcaaccua

SEQ ID NO: 98545 - DNA, 28 bp, Artificial Sequence
  Synthetic
gctgttacataauttgtcaggttgtuga

SEQ ID NO: 98546 - DNA, 21 bp, Artificial Sequence
  Synthetic
ccaggttcucctcacagctug

SEQ ID NO: 98547 - DNA, 20 bp, Artificial Sequence
  Synthetic
ctgggacugctccgaagaug

SEQ ID NO: 98548 - DNA, 19 bp, Artificial Sequence
  Synthetic
tgggccuaacgggttucac

SEQ ID NO: 98549 - DNA, 23 bp, Artificial Sequence
  Synthetic
cctgguggacatcgtuaaaggaa

SEQ ID NO: 98550 - DNA, 21 bp, Artificial Sequence
  Synthetic
cctgggtcucacactcaucca

SEQ ID NO: 98551 - DNA, 20 bp, Artificial Sequence
  Synthetic
gccacauccaugacacccat

SEQ ID NO: 98552 - DNA, 23 bp, Artificial Sequence
  Synthetic
ctgcagctugtagtaggagtugg

SEQ ID NO: 98553 - DNA, 21 bp, Artificial Sequence
  Synthetic
cccttctccgugagagtgcua

SEQ ID NO: 98554 - DNA, 21 bp, Artificial Sequence
  Synthetic
cutccctaugccaggcagaaa

SEQ ID NO: 98555 - DNA, 25 bp, Artificial Sequence
  Synthetic
caggtaauaggcaccctugaagaag

SEQ ID NO: 98556 - DNA, 24 bp, Artificial Sequence
  Synthetic
tttctctaucccaggtcacagcua

SEQ ID NO: 98557 - DNA, 22 bp, Artificial Sequence
  Synthetic
gtgtaucgaaggcaguggagag

SEQ ID NO: 98558 - DNA, 24 bp, Artificial Sequence
  Synthetic
aaagagcaaaggaagucagtgugt

SEQ ID NO: 98559 - DNA, 22 bp, Artificial Sequence
  Synthetic
ggaaagaguccgcccactttua

SEQ ID NO: 98560 - DNA, 23 bp, Artificial Sequence
  Synthetic
cagattucagggacgatcgtuga

SEQ ID NO: 98561 - DNA, 24 bp, Artificial Sequence
  Synthetic
ccaucagaaaaggtuccccaaaaa

SEQ ID NO: 98562 - DNA, 22 bp, Artificial Sequence
  Synthetic
cctgtggccuctgtgtgattut

SEQ ID NO: 98563 - DNA, 27 bp, Artificial Sequence
  Synthetic
gactaatgctatugacaatgcactucc

SEQ ID NO: 98564 - DNA, 21 bp, Artificial Sequence
  Synthetic
gctgcagggugactgaagaug

SEQ ID NO: 98565 - DNA, 20 bp, Artificial Sequence
  Synthetic
ggcctcguataccgcaucaa

SEQ ID NO: 98566 - DNA, 19 bp, Artificial Sequence
  Synthetic
ccugagcucccggaaaaga

SEQ ID NO: 98567 - DNA, 24 bp, Artificial Sequence
  Synthetic
gcataggaacugtggttugagagg

SEQ ID NO: 98568 - DNA, 21 bp, Artificial Sequence
  Synthetic
ctgggtuaaagtgcugccaag

SEQ ID NO: 98569 - DNA, 25 bp, Artificial Sequence
  Synthetic
caauggatuaggccaaaagaaacca

SEQ ID NO: 98570 - DNA, 21 bp, Artificial Sequence
  Synthetic
ccatgttgcuggagagucaga

SEQ ID NO: 98571 - DNA, 23 bp, Artificial Sequence
  Synthetic
tgggcaugcaggtggatatttut

SEQ ID NO: 98572 - DNA, 27 bp, Artificial Sequence
  Synthetic
gttattgttcagutggtcacaaaugga

SEQ ID NO: 98573 - DNA, 26 bp, Artificial Sequence
  Synthetic
ccacagcatcauatacccctactuac

SEQ ID NO: 98574 - DNA, 18 bp, Artificial Sequence
  Synthetic
gggugcagaagagccuca

SEQ ID NO: 98575 - DNA, 17 bp, Artificial Sequence
  Synthetic
ggcgguggtagguggaa

SEQ ID NO: 98576 - DNA, 22 bp, Artificial Sequence
  Synthetic
agtggtcttuctgtggctagug

SEQ ID NO: 98577 - DNA, 25 bp, Artificial Sequence
  Synthetic
cgaaactauccgaaaaatugggcat

SEQ ID NO: 98578 - DNA, 22 bp, Artificial Sequence
  Synthetic
gcagaggaaacgucagaagcuc

SEQ ID NO: 98579 - DNA, 23 bp, Artificial Sequence
  Synthetic
ttgtaccuggacctgtactucca

SEQ ID NO: 98580 - DNA, 26 bp, Artificial Sequence
  Synthetic
ggaaaugaatactgaguagccaggaa

SEQ ID NO: 98581 - DNA, 26 bp, Artificial Sequence
  Synthetic
acttgaaaaacuggatctgcugaagt

SEQ ID NO: 98582 - DNA, 20 bp, Artificial Sequence
  Synthetic
gcggaggcaugtttgguagt

SEQ ID NO: 98583 - DNA, 33 bp, Artificial Sequence
  Synthetic
aatatactcaataataucatagccactcaacuc

SEQ ID NO: 98584 - DNA, 24 bp, Artificial Sequence
  Synthetic
aaggaggaaagccaaguatctgug

SEQ ID NO: 98585 - DNA, 28 bp, Artificial Sequence
  Synthetic
catcctgacaauattactgtgcugagaa

SEQ ID NO: 98586 - DNA, 27 bp, Artificial Sequence
  Synthetic
gcaaggtacutaatgtttctuggcaaa

SEQ ID NO: 98587 - DNA, 28 bp, Artificial Sequence
  Synthetic
ccacagatatgtucttcctcaatgcaua

SEQ ID NO: 98588 - DNA, 25 bp, Artificial Sequence
  Synthetic
ttctcatctuttgcaggtugaggat

SEQ ID NO: 98589 - DNA, 27 bp, Artificial Sequence
  Synthetic
ccctaggttguatttccttgaggauca

SEQ ID NO: 98590 - DNA, 21 bp, Artificial Sequence
  Synthetic
tcugtctcctguaccccaaca

SEQ ID NO: 98591 - DNA, 20 bp, Artificial Sequence
  Synthetic
gcggttagagutctgccgut

SEQ ID NO: 98592 - DNA, 21 bp, Artificial Sequence
  Synthetic
gggttacccucgatccctcua

SEQ ID NO: 98593 - DNA, 21 bp, Artificial Sequence
  Synthetic
acacacaggucagacaugcag

SEQ ID NO: 98594 - DNA, 29 bp, Artificial Sequence
  Synthetic
agcataaggaaugtgtttaatgaguagca

SEQ ID NO: 98595 - DNA, 20 bp, Artificial Sequence
  Synthetic
tccuccgaagcuggacaaac

SEQ ID NO: 98596 - DNA, 27 bp, Artificial Sequence
  Synthetic
gccattgtctucaaaactccaaaguat

SEQ ID NO: 98597 - DNA, 28 bp, Artificial Sequence
  Synthetic
aacaactgacutacctttgattucagga

SEQ ID NO: 98598 - DNA, 18 bp, Artificial Sequence
  Synthetic
gggcttguggcacctuga

SEQ ID NO: 98599 - DNA, 18 bp, Artificial Sequence
  Synthetic
aggaagggucaggugggt

SEQ ID NO: 98600 - DNA, 26 bp, Artificial Sequence
  Synthetic
cagactgtcatuatcctgttctgugt

SEQ ID NO: 98601 - DNA, 25 bp, Artificial Sequence
  Synthetic
cttatctcctcutgtcctctgctug

SEQ ID NO: 98602 - DNA, 22 bp, Artificial Sequence
  Synthetic
tttcctcccuctgccctctuaa

SEQ ID NO: 98603 - DNA, 25 bp, Artificial Sequence
  Synthetic
gctgaagaaaagcuaggaggaacuc

SEQ ID NO: 98604 - DNA, 21 bp, Artificial Sequence
  Synthetic
ggctgcuctctcctgauaggt

SEQ ID NO: 98605 - DNA, 21 bp, Artificial Sequence
  Synthetic
cccuagaccagcagctgttug

SEQ ID NO: 98606 - DNA, 23 bp, Artificial Sequence
  Synthetic
agcccucagaaagcatttuaggt

SEQ ID NO: 98607 - DNA, 27 bp, Artificial Sequence
  Synthetic
aacctcagaatccuttcttcctgaauc

SEQ ID NO: 98608 - DNA, 21 bp, Artificial Sequence
  Synthetic
ctacccucagagucagggaca

SEQ ID NO: 98609 - DNA, 21 bp, Artificial Sequence
  Synthetic
tgugagaaaggcugcaacact

SEQ ID NO: 98610 - DNA, 20 bp, Artificial Sequence
  Synthetic
atcttcaggccugcagucac

SEQ ID NO: 98611 - DNA, 26 bp, Artificial Sequence
  Synthetic
tctagggugaagaaaagagtcaggut

SEQ ID NO: 98612 - DNA, 31 bp, Artificial Sequence
  Synthetic
tcttaaagcatautcaatctgtgcuaacagt

SEQ ID NO: 98613 - DNA, 27 bp, Artificial Sequence
  Synthetic
caaagagaactuttcaatcacccucat

SEQ ID NO: 98614 - DNA, 24 bp, Artificial Sequence
  Synthetic
caagtcgagcutctgagatucgat

SEQ ID NO: 98615 - DNA, 26 bp, Artificial Sequence
  Synthetic
ggguaaaccaggaatatucagagagg

SEQ ID NO: 98616 - DNA, 28 bp, Artificial Sequence
  Synthetic
ttcctttttcttucatcttcctcacugt

SEQ ID NO: 98617 - DNA, 28 bp, Artificial Sequence
  Synthetic
ccatttcctuggcaacaaaaatcattuc

SEQ ID NO: 98618 - DNA, 22 bp, Artificial Sequence
  Synthetic
actcatcacuccttcccuggat

SEQ ID NO: 98619 - DNA, 27 bp, Artificial Sequence
  Synthetic
tttgaagugaggacaaagctcatuagt

SEQ ID NO: 98620 - DNA, 20 bp, Artificial Sequence
  Synthetic
cgguacccccactcucacaa

SEQ ID NO: 98621 - DNA, 24 bp, Artificial Sequence
  Synthetic
gcccaaagcaaacauccatgatua

SEQ ID NO: 98622 - DNA, 27 bp, Artificial Sequence
  Synthetic
gatggaagttaaaguttctgggaguct

SEQ ID NO: 98623 - DNA, 22 bp, Artificial Sequence
  Synthetic
ttcgttgtacutctggctgguc

SEQ ID NO: 98624 - DNA, 25 bp, Artificial Sequence
  Synthetic
cacgggaagaaaucaaagagtccut

SEQ ID NO: 98625 - DNA, 22 bp, Artificial Sequence
  Synthetic
cgagaggaugacagaugaggct

SEQ ID NO: 98626 - DNA, 32 bp, Artificial Sequence
  Synthetic
aatgtcttcaagtugtctacaataaagtttut

SEQ ID NO: 98627 - DNA, 26 bp, Artificial Sequence
  Synthetic
tgagactcaaugatggcauaccaaag

SEQ ID NO: 98628 - DNA, 28 bp, Artificial Sequence
  Synthetic
agctacataaacuacacacacacatcug

SEQ ID NO: 98629 - DNA, 26 bp, Artificial Sequence
  Synthetic
cttaatttcutaacagctucggcagt

SEQ ID NO: 98630 - DNA, 19 bp, Artificial Sequence
  Synthetic
gcagggucccgcgaatuag

SEQ ID NO: 98631 - DNA, 23 bp, Artificial Sequence
  Synthetic
cccaggucctcaacttugaagag

SEQ ID NO: 98632 - DNA, 25 bp, Artificial Sequence
  Synthetic
ttttcttagautgctgcuggacact

SEQ ID NO: 98633 - DNA, 28 bp, Artificial Sequence
  Synthetic
gcatctgauagagaaggtaggacatuct

SEQ ID NO: 98634 - DNA, 27 bp, Artificial Sequence
  Synthetic
gcttaggtaugtttctcaaugagcact

SEQ ID NO: 98635 - DNA, 27 bp, Artificial Sequence
  Synthetic
catttcggccautttgctttaagguat

SEQ ID NO: 98636 - DNA, 23 bp, Artificial Sequence
  Synthetic
acctcgatcuccttgtagucgat

SEQ ID NO: 98637 - DNA, 18 bp, Artificial Sequence
  Synthetic
gggtcucacccggatugt

SEQ ID NO: 98638 - DNA, 26 bp, Artificial Sequence
  Synthetic
tgccttctgcutatctttttcctcut

SEQ ID NO: 98639 - DNA, 20 bp, Artificial Sequence
  Synthetic
tccctcuccacgacatccut

SEQ ID NO: 98640 - DNA, 23 bp, Artificial Sequence
  Synthetic
actgactcccutacagttcucca

SEQ ID NO: 98641 - DNA, 24 bp, Artificial Sequence
  Synthetic
ctagtggcgagcuggattcuaaat

SEQ ID NO: 98642 - DNA, 23 bp, Artificial Sequence
  Synthetic
tgcccttugggcttctctauact

SEQ ID NO: 98643 - DNA, 28 bp, Artificial Sequence
  Synthetic
gcacctgtctaaautaatcttgggttuc

SEQ ID NO: 98644 - DNA, 21 bp, Artificial Sequence
  Synthetic
gcagtcagugcagtgcaagua

SEQ ID NO: 98645 - DNA, 25 bp, Artificial Sequence
  Synthetic
tgaagacacaucatugacagacgac

SEQ ID NO: 98646 - DNA, 21 bp, Artificial Sequence
  Synthetic
cacttccugctgagauggcaa

SEQ ID NO: 98647 - DNA, 22 bp, Artificial Sequence
  Synthetic
ccagcgcaagcutaaagacauc

SEQ ID NO: 98648 - DNA, 23 bp, Artificial Sequence
  Synthetic
cgcaaagutgtaaaagcucagca

SEQ ID NO: 98649 - DNA, 24 bp, Artificial Sequence
  Synthetic
gctggtgtacuccactatttcugt

SEQ ID NO: 98650 - DNA, 21 bp, Artificial Sequence
  Synthetic
gcactauccagctgtcugcaa

SEQ ID NO: 98651 - DNA, 28 bp, Artificial Sequence
  Synthetic
ctaatatucccggccaaaaagaaaugaa

SEQ ID NO: 98652 - DNA, 27 bp, Artificial Sequence
  Synthetic
tggtgtggaaugtctagtattcucaca

SEQ ID NO: 98653 - DNA, 28 bp, Artificial Sequence
  Synthetic
gcttctccttauttagagtgaacuggat

SEQ ID NO: 98654 - DNA, 25 bp, Artificial Sequence
  Synthetic
ccaagtgatucagatggagcuagat

SEQ ID NO: 98655 - DNA, 28 bp, Artificial Sequence
  Synthetic
gacgatagtttctuctactaacccgaug

SEQ ID NO: 98656 - DNA, 22 bp, Artificial Sequence
  Synthetic
tccaccucagacggaaattgug

SEQ ID NO: 98657 - DNA, 29 bp, Artificial Sequence
  Synthetic
ctctggcttaatauctctgtgaatcacut

SEQ ID NO: 98658 - DNA, 21 bp, Artificial Sequence
  Synthetic
gtgctggutgtctcatuacgg

SEQ ID NO: 98659 - DNA, 22 bp, Artificial Sequence
  Synthetic
aaatcacacgcaccutcctuct

SEQ ID NO: 98660 - DNA, 24 bp, Artificial Sequence
  Synthetic
ctctggttucagtgtcatgtguct

SEQ ID NO: 98661 - DNA, 19 bp, Artificial Sequence
  Synthetic
gaagtggugcagccacuct

SEQ ID NO: 98662 - DNA, 20 bp, Artificial Sequence
  Synthetic
caagaccagcggcuaaucca

SEQ ID NO: 98663 - DNA, 27 bp, Artificial Sequence
  Synthetic
gatccacacaucagacattcatctcua

SEQ ID NO: 98664 - DNA, 22 bp, Artificial Sequence
  Synthetic
ccatcaaaugcagcaacctgug

SEQ ID NO: 98665 - DNA, 27 bp, Artificial Sequence
  Synthetic
cttacaactaugcaaactccctucact

SEQ ID NO: 98666 - DNA, 22 bp, Artificial Sequence
  Synthetic
cagccaggaacaugagctctua

SEQ ID NO: 98667 - DNA, 27 bp, Artificial Sequence
  Synthetic
tctcactacugcaaaacctttctctut

SEQ ID NO: 98668 - DNA, 20 bp, Artificial Sequence
  Synthetic
ccatggatugaggcctcugg

SEQ ID NO: 98669 - DNA, 27 bp, Artificial Sequence
  Synthetic
caaaacaagagcacagutgaaacauct

SEQ ID NO: 98670 - DNA, 23 bp, Artificial Sequence
  Synthetic
ggctctcagcauccatcatcauc

SEQ ID NO: 98671 - DNA, 20 bp, Artificial Sequence
  Synthetic
gactaaccgacuccccaucc

SEQ ID NO: 98672 - DNA, 22 bp, Artificial Sequence
  Synthetic
ctgaccuactgccaugacaaga

SEQ ID NO: 98673 - DNA, 23 bp, Artificial Sequence
  Synthetic
gtactcagaacucacccuaccac

SEQ ID NO: 98674 - DNA, 24 bp, Artificial Sequence
  Synthetic
ccaguacaaggactctttcugcat

SEQ ID NO: 98675 - DNA, 23 bp, Artificial Sequence
  Synthetic
tcctcacauccctgatctcaucc

SEQ ID NO: 98676 - DNA, 22 bp, Artificial Sequence
  Synthetic
ccatggugtgctcttuggagaa

SEQ ID NO: 98677 - DNA, 29 bp, Artificial Sequence
  Synthetic
cccactauacctatctatgcucaagaagt

SEQ ID NO: 98678 - DNA, 23 bp, Artificial Sequence
  Synthetic
ctctgcccutcacucaacaaaga

SEQ ID NO: 98679 - DNA, 24 bp, Artificial Sequence
  Synthetic
gtgctttgcugaattttggcaaut

SEQ ID NO: 98680 - DNA, 26 bp, Artificial Sequence
  Synthetic
tccctgatucaacgacatagaguaca

SEQ ID NO: 98681 - DNA, 27 bp, Artificial Sequence
  Synthetic
attcttggcaacutaaaattucacgct

SEQ ID NO: 98682 - DNA, 28 bp, Artificial Sequence
  Synthetic
aatagcacagacugaagcatcttuagag

SEQ ID NO: 98683 - DNA, 26 bp, Artificial Sequence
  Synthetic
atttggttagctutcatccccatcut

SEQ ID NO: 98684 - DNA, 25 bp, Artificial Sequence
  Synthetic
gatatttcccccaagugacacagua

SEQ ID NO: 98685 - DNA, 22 bp, Artificial Sequence
  Synthetic
gcatctgauggctccataccug

SEQ ID NO: 98686 - DNA, 21 bp, Artificial Sequence
  Synthetic
gctgacugggctguaccaaaa

SEQ ID NO: 98687 - DNA, 26 bp, Artificial Sequence
  Synthetic
atggtcactugtactgtttaugccat

SEQ ID NO: 98688 - DNA, 21 bp, Artificial Sequence
  Synthetic
cugaggtucagccagcaaaga

SEQ ID NO: 98689 - DNA, 21 bp, Artificial Sequence
  Synthetic
tgtccttucaatggccuccac

SEQ ID NO: 98690 - DNA, 21 bp, Artificial Sequence
  Synthetic
gautgugaaagacgccacgac

SEQ ID NO: 98691 - DNA, 23 bp, Artificial Sequence
  Synthetic
agccautagacugggaaaaagca

SEQ ID NO: 98692 - DNA, 22 bp, Artificial Sequence
  Synthetic
ccagugggcaaaaggaaaucca

SEQ ID NO: 98693 - DNA, 29 bp, Artificial Sequence
  Synthetic
ggctgatggtugttttgctatgtttuaat

SEQ ID NO: 98694 - DNA, 20 bp, Artificial Sequence
  Synthetic
gctcccccucttctggugaa

SEQ ID NO: 98695 - DNA, 20 bp, Artificial Sequence
  Synthetic
ctgtttccgugcagcaugag

SEQ ID NO: 98696 - DNA, 25 bp, Artificial Sequence
  Synthetic
atttcctctuggaagggatucaaca

SEQ ID NO: 98697 - DNA, 20 bp, Artificial Sequence
  Synthetic
ccugcacccagactacaucc

SEQ ID NO: 98698 - DNA, 24 bp, Artificial Sequence
  Synthetic
atgtacattutccccatuccccat

SEQ ID NO: 98699 - DNA, 26 bp, Artificial Sequence
  Synthetic
gtcaagcaaaccuggaacacaatuac

SEQ ID NO: 98700 - DNA, 23 bp, Artificial Sequence
  Synthetic
tctctgggacaccuctcgtttua

SEQ ID NO: 98701 - DNA, 25 bp, Artificial Sequence
  Synthetic
ccccacaucatcattgactauggag

SEQ ID NO: 98702 - DNA, 23 bp, Artificial Sequence
  Synthetic
cttaccacauccaccuggacaag

SEQ ID NO: 98703 - DNA, 25 bp, Artificial Sequence
  Synthetic
tcttgaagagacugagacctcucaa

SEQ ID NO: 98704 - DNA, 22 bp, Artificial Sequence
  Synthetic
aatacuggagcggauggcaaat

SEQ ID NO: 98705 - DNA, 26 bp, Artificial Sequence
  Synthetic
acagcatguttgggaaaauaacaacc

SEQ ID NO: 98706 - DNA, 28 bp, Artificial Sequence
  Synthetic
acaaagtcagguaattcttguaaaccca

SEQ ID NO: 98707 - DNA, 24 bp, Artificial Sequence
  Synthetic
accttgcagaaugactacttugct

SEQ ID NO: 98708 - DNA, 26 bp, Artificial Sequence
  Synthetic
ttccctuaaccaagacaattuggaaa

SEQ ID NO: 98709 - DNA, 27 bp, Artificial Sequence
  Synthetic
gatgacaatugcattgctagcauagaa

SEQ ID NO: 98710 - DNA, 23 bp, Artificial Sequence
  Synthetic
gacaaggucactggttctugagt

SEQ ID NO: 98711 - DNA, 20 bp, Artificial Sequence
  Synthetic
ggagccugaggaugaaggag

SEQ ID NO: 98712 - DNA, 22 bp, Artificial Sequence
  Synthetic
gggtgacgacutcttgttugat

SEQ ID NO: 98713 - DNA, 23 bp, Artificial Sequence
  Synthetic
cccagcttcaucacagagtccua

SEQ ID NO: 98714 - DNA, 22 bp, Artificial Sequence
  Synthetic
ctggaatcaccutgctgtccut

SEQ ID NO: 98715 - DNA, 19 bp, Artificial Sequence
  Synthetic
cagtctcuggcctccccua

SEQ ID NO: 98716 - DNA, 20 bp, Artificial Sequence
  Synthetic
tggatctagugtccgcugct

SEQ ID NO: 98717 - DNA, 21 bp, Artificial Sequence
  Synthetic
cagcgcccaagutcattaguc

SEQ ID NO: 98718 - DNA, 20 bp, Artificial Sequence
  Synthetic
tgatgggauggagcgtcuga

SEQ ID NO: 98719 - DNA, 25 bp, Artificial Sequence
  Synthetic
ctcctctcttuacttgcaaacccut

SEQ ID NO: 98720 - DNA, 22 bp, Artificial Sequence
  Synthetic
catgccaaguccuaggaagacc

SEQ ID NO: 98721 - DNA, 22 bp, Artificial Sequence
  Synthetic
gatcgtgaccuttgtccgcuat

SEQ ID NO: 98722 - DNA, 21 bp, Artificial Sequence
  Synthetic
gtgaucaccagctgagaugct

SEQ ID NO: 98723 - DNA, 26 bp, Artificial Sequence
  Synthetic
cagatacaaucatatgctcctuccga

SEQ ID NO: 98724 - DNA, 20 bp, Artificial Sequence
  Synthetic
gccccaucaagcacatcuca

SEQ ID NO: 98725 - DNA, 28 bp, Artificial Sequence
  Synthetic
ctccctggaugaggatagaaaaatgaut

SEQ ID NO: 98726 - DNA, 29 bp, Artificial Sequence
  Synthetic
aaatattaccuagtccacaugccaaaagt

SEQ ID NO: 98727 - DNA, 24 bp, Artificial Sequence
  Synthetic
agcgtggguaaatacgatggttut

SEQ ID NO: 98728 - DNA, 23 bp, Artificial Sequence
  Synthetic
acataaccuccacctctctcugt

SEQ ID NO: 98729 - DNA, 26 bp, Artificial Sequence
  Synthetic
ctgaaaggtguagacttccagaagut

SEQ ID NO: 98730 - DNA, 28 bp, Artificial Sequence
  Synthetic
tccagttctcaautgtcctttaaaguca

SEQ ID NO: 98731 - DNA, 26 bp, Artificial Sequence
  Synthetic
aggacatgtgcaugtttacacctuaa

SEQ ID NO: 98732 - DNA, 27 bp, Artificial Sequence
  Synthetic
ggcactagaaacuggaaaaacuaaacc

SEQ ID NO: 98733 - DNA, 28 bp, Artificial Sequence
  Synthetic
tgttttcagagaaaguttcattgugcaa

SEQ ID NO: 98734 - DNA, 22 bp, Artificial Sequence
  Synthetic
cagcgaggccaugaagtuagat

SEQ ID NO: 98735 - DNA, 28 bp, Artificial Sequence
  Synthetic
cctaggccaaaaucatttttcagatgut

SEQ ID NO: 98736 - DNA, 20 bp, Artificial Sequence
  Synthetic
gautcacugcgcaaagcaca

SEQ ID NO: 98737 - DNA, 28 bp, Artificial Sequence
  Synthetic
gtttaatcaaacugaatgccgtgaagut

SEQ ID NO: 98738 - DNA, 22 bp, Artificial Sequence
  Synthetic
ccctcacgauaggtgtgtcaut

SEQ ID NO: 98739 - DNA, 21 bp, Artificial Sequence
  Synthetic
tgccagctuatccccatcauc

SEQ ID NO: 98740 - DNA, 27 bp, Artificial Sequence
  Synthetic
aggtagaaactuctcatccagguaaca

SEQ ID NO: 98741 - DNA, 22 bp, Artificial Sequence
  Synthetic
acaggcagcutcaaaagauggt

SEQ ID NO: 98742 - DNA, 25 bp, Artificial Sequence
  Synthetic
aggcttcucatagaacaguccagaa

SEQ ID NO: 98743 - DNA, 21 bp, Artificial Sequence
  Synthetic
gcaatgtgcccugggaattug

SEQ ID NO: 98744 - DNA, 30 bp, Artificial Sequence
  Synthetic
atgaagtatatuccaacagaagatgttuca

SEQ ID NO: 98745 - DNA, 28 bp, Artificial Sequence
  Synthetic
gttcttccagugacagacctaauaacaa

SEQ ID NO: 98746 - DNA, 29 bp, Artificial Sequence
  Synthetic
ccaacagaagaugtttcagguaaaacaaa

SEQ ID NO: 98747 - DNA, 24 bp, Artificial Sequence
  Synthetic
cgttcttctugcaacctccucaat

SEQ ID NO: 98748 - DNA, 22 bp, Artificial Sequence
  Synthetic
ctccttcccuttggctctgtut

SEQ ID NO: 98749 - DNA, 28 bp, Artificial Sequence
  Synthetic
gggagcaggugttattgattgataugat

SEQ ID NO: 98750 - DNA, 27 bp, Artificial Sequence
  Synthetic
gttattagguctgtcacuggaagaaca

SEQ ID NO: 98751 - DNA, 25 bp, Artificial Sequence
  Synthetic
gattataccccugcaaauagggcat

SEQ ID NO: 98752 - DNA, 21 bp, Artificial Sequence
  Synthetic
agggctgcuccattcauacag

SEQ ID NO: 98753 - DNA, 27 bp, Artificial Sequence
  Synthetic
tggatcttcatcugatctctttccuca

SEQ ID NO: 98754 - DNA, 19 bp, Artificial Sequence
  Synthetic
ccctgagcguctgggaauc

SEQ ID NO: 98755 - DNA, 20 bp, Artificial Sequence
  Synthetic
gtgcatcagcuccttgguct

SEQ ID NO: 98756 - DNA, 24 bp, Artificial Sequence
  Synthetic
ggaatgugccccttctcuaagaaa

SEQ ID NO: 98757 - DNA, 28 bp, Artificial Sequence
  Synthetic
ctttagatggcutcaagtgtucaacaat

SEQ ID NO: 98758 - DNA, 23 bp, Artificial Sequence
  Synthetic
cccagcacauagtcgggaatuac

SEQ ID NO: 98759 - DNA, 24 bp, Artificial Sequence
  Synthetic
tgtggttaucaagggtcatcccua

SEQ ID NO: 98760 - DNA, 22 bp, Artificial Sequence
  Synthetic
ggguggtgagagugagagagaa

SEQ ID NO: 98761 - DNA, 23 bp, Artificial Sequence
  Synthetic
tttacagtgtucccaaggagugg

SEQ ID NO: 98762 - DNA, 22 bp, Artificial Sequence
  Synthetic
gtcaagcugagctcucagaaga

SEQ ID NO: 98763 - DNA, 19 bp, Artificial Sequence
  Synthetic
gtgggaggaacccutgugg

SEQ ID NO: 98764 - DNA, 23 bp, Artificial Sequence
  Synthetic
gggaagcctutggcacagattua

SEQ ID NO: 98765 - DNA, 22 bp, Artificial Sequence
  Synthetic
gcaagacacutcccaguaagcc

SEQ ID NO: 98766 - DNA, 28 bp, Artificial Sequence
  Synthetic
cagagttaaaatacucccagcatacuga

SEQ ID NO: 98767 - DNA, 28 bp, Artificial Sequence
  Synthetic
gttttccctcuaagaatctgacgaaugt

SEQ ID NO: 98768 - DNA, 22 bp, Artificial Sequence
  Synthetic
agggagaaugccactccaatut

SEQ ID NO: 98769 - DNA, 24 bp, Artificial Sequence
  Synthetic
tgtgaaggtuacaactaccaggug

SEQ ID NO: 98770 - DNA, 23 bp, Artificial Sequence
  Synthetic
gggttgcaugctgtgaagauaag

SEQ ID NO: 98771 - DNA, 28 bp, Artificial Sequence
  Synthetic
gcttgcattcacautgtgtcttttgtua

SEQ ID NO: 98772 - DNA, 23 bp, Artificial Sequence
  Synthetic
caaagtucacaggacagctcauc

SEQ ID NO: 98773 - DNA, 22 bp, Artificial Sequence
  Synthetic
catgcagugggctcauagagaa

SEQ ID NO: 98774 - DNA, 23 bp, Artificial Sequence
  Synthetic
gcuggtaagtguagaggcagact

SEQ ID NO: 98775 - DNA, 27 bp, Artificial Sequence
  Synthetic
gccttttcctutttataggctcuggat

SEQ ID NO: 98776 - DNA, 29 bp, Artificial Sequence
  Synthetic
tcacagagtatcutaagtgcagaacuaca

SEQ ID NO: 98777 - DNA, 23 bp, Artificial Sequence
  Synthetic
aagaggagccuttggagttgtut

SEQ ID NO: 98778 - DNA, 22 bp, Artificial Sequence
  Synthetic
gtgagccutgctttctcugaag

SEQ ID NO: 98779 - DNA, 24 bp, Artificial Sequence
  Synthetic
ctttctggauctcaatggctucca

SEQ ID NO: 98780 - DNA, 26 bp, Artificial Sequence
  Synthetic
catcttttgctcuccacttagcttug

SEQ ID NO: 98781 - DNA, 27 bp, Artificial Sequence
  Synthetic
attgggctgatcuatttgattccgaut

SEQ ID NO: 98782 - DNA, 19 bp, Artificial Sequence
  Synthetic
cagacgccgggugagtaug

SEQ ID NO: 98783 - DNA, 25 bp, Artificial Sequence
  Synthetic
attacaaacccguggctaggatuag

SEQ ID NO: 98784 - DNA, 23 bp, Artificial Sequence
  Synthetic
ccactctgccugggtatcttcua

SEQ ID NO: 98785 - DNA, 21 bp, Artificial Sequence
  Synthetic
tggccttugtccacgaaugag

SEQ ID NO: 98786 - DNA, 21 bp, Artificial Sequence
  Synthetic
ggcuccaggcaggaaacuaac

SEQ ID NO: 98787 - DNA, 25 bp, Artificial Sequence
  Synthetic
gcccatgaacutgattatggcuacc

SEQ ID NO: 98788 - DNA, 26 bp, Artificial Sequence
  Synthetic
caagtagctcttucccatcaatggua

SEQ ID NO: 98789 - DNA, 27 bp, Artificial Sequence
  Synthetic
gaattgcucgggattcatcttaugaac

SEQ ID NO: 98790 - DNA, 22 bp, Artificial Sequence
  Synthetic
gagtggctgugctacatgttug

SEQ ID NO: 98791 - DNA, 21 bp, Artificial Sequence
  Synthetic
acagattctuccccagcgtut

SEQ ID NO: 98792 - DNA, 28 bp, Artificial Sequence
  Synthetic
tcaattacaaatuggacctttcctucct

SEQ ID NO: 98793 - DNA, 27 bp, Artificial Sequence
  Synthetic
tcgtgtctcautaagtgttccucaaat

SEQ ID NO: 98794 - DNA, 19 bp, Artificial Sequence
  Synthetic
gaagtccgggutcgagguc

SEQ ID NO: 98795 - DNA, 21 bp, Artificial Sequence
  Synthetic
gctacaccaaccuctcguaca

SEQ ID NO: 98796 - DNA, 19 bp, Artificial Sequence
  Synthetic
cgccgatguacgagaggut

SEQ ID NO: 98797 - DNA, 17 bp, Artificial Sequence
  Synthetic
ccgagcgucgagcucag

SEQ ID NO: 98798 - DNA, 19 bp, Artificial Sequence
  Synthetic
caccccgcaauctuggaca

SEQ ID NO: 98799 - DNA, 21 bp, Artificial Sequence
  Synthetic
gaacgcugatgacagcuacga

SEQ ID NO: 98800 - DNA, 22 bp, Artificial Sequence
  Synthetic
gcguagtacccugcaaaagact

SEQ ID NO: 98801 - DNA, 25 bp, Artificial Sequence
  Synthetic
aagcacaggaugtttttcuccaaac

SEQ ID NO: 98802 - DNA, 22 bp, Artificial Sequence
  Synthetic
cctggttucctgctctacugga

SEQ ID NO: 98803 - DNA, 20 bp, Artificial Sequence
  Synthetic
gctgagcacagugtcugcat

SEQ ID NO: 98804 - DNA, 26 bp, Artificial Sequence
  Synthetic
tgctctcugaaaatggttuccagaat

SEQ ID NO: 98805 - DNA, 23 bp, Artificial Sequence
  Synthetic
gaacaaaggtugccacacaguag

SEQ ID NO: 98806 - DNA, 28 bp, Artificial Sequence
  Synthetic
ctttacagacaugtaagtggtgcuaact

SEQ ID NO: 98807 - DNA, 28 bp, Artificial Sequence
  Synthetic
cgtcttggacautactaaaattgtguga

SEQ ID NO: 98808 - DNA, 27 bp, Artificial Sequence
  Synthetic
cagcaguggagagatttgtttatucct

SEQ ID NO: 98809 - DNA, 28 bp, Artificial Sequence
  Synthetic
ttctgcactaaauaaactcacctgtcuc

SEQ ID NO: 98810 - DNA, 25 bp, Artificial Sequence
  Synthetic
tggttgctgcuttgagaatcatcut

SEQ ID NO: 98811 - DNA, 21 bp, Artificial Sequence
  Synthetic
agaaagccucgagctcaucag

SEQ ID NO: 98812 - DNA, 24 bp, Artificial Sequence
  Synthetic
gggtctcaggutgtgtttattugg

SEQ ID NO: 98813 - DNA, 21 bp, Artificial Sequence
  Synthetic
cccctcgcuttcaccttucag

SEQ ID NO: 98814 - DNA, 28 bp, Artificial Sequence
  Synthetic
aggtacuggaggaaagtttauggaaaac

SEQ ID NO: 98815 - DNA, 26 bp, Artificial Sequence
  Synthetic
agtgtactuccctttgctguaaacaa

SEQ ID NO: 98816 - DNA, 27 bp, Artificial Sequence
  Synthetic
tgacattgttuacagcaaagggaagua

SEQ ID NO: 98817 - DNA, 28 bp, Artificial Sequence
  Synthetic
aggaaaaugtgatatucagagagagcaa

SEQ ID NO: 98818 - DNA, 21 bp, Artificial Sequence
  Synthetic
gctaccucccacccatucact

SEQ ID NO: 98819 - DNA, 21 bp, Artificial Sequence
  Synthetic
tcccccuaccttaccctucac

SEQ ID NO: 98820 - DNA, 20 bp, Artificial Sequence
  Synthetic
tgtggtuaccccagcaugag

SEQ ID NO: 98821 - DNA, 21 bp, Artificial Sequence
  Synthetic
aacgaguggcgaatgaucaca

SEQ ID NO: 98822 - DNA, 26 bp, Artificial Sequence
  Synthetic
tcacagactgtucttgcatatgagut

SEQ ID NO: 98823 - DNA, 28 bp, Artificial Sequence
  Synthetic
acagattatugaaaaggcagctgagaut

SEQ ID NO: 98824 - DNA, 26 bp, Artificial Sequence
  Synthetic
ctgacacatuagcactatcactgcut

SEQ ID NO: 98825 - DNA, 25 bp, Artificial Sequence
  Synthetic
agcatagcaaugccagatcttaugt

SEQ ID NO: 98826 - DNA, 21 bp, Artificial Sequence
  Synthetic
ccgcttcggauggtgttcaut

SEQ ID NO: 98827 - DNA, 23 bp, Artificial Sequence
  Synthetic
tcctcaatcguctcctttaugcc

SEQ ID NO: 98828 - DNA, 25 bp, Artificial Sequence
  Synthetic
gtcaaaatacugcattggcugaaca

SEQ ID NO: 98829 - DNA, 22 bp, Artificial Sequence
  Synthetic
gaacttugggagcccctaucat

SEQ ID NO: 98830 - DNA, 23 bp, Artificial Sequence
  Synthetic
ttgttcttugcacctctctcucc

SEQ ID NO: 98831 - DNA, 26 bp, Artificial Sequence
  Synthetic
ggctctcaaauacagtcagaggguat

SEQ ID NO: 98832 - DNA, 21 bp, Artificial Sequence
  Synthetic
cctccctugctagagcucact

SEQ ID NO: 98833 - DNA, 25 bp, Artificial Sequence
  Synthetic
aagttcgacauggaattggaugact

SEQ ID NO: 98834 - DNA, 27 bp, Artificial Sequence
  Synthetic
cctacagauaagagagcactuggagat

SEQ ID NO: 98835 - DNA, 24 bp, Artificial Sequence
  Synthetic
tggaattatguttcgacacuggct

SEQ ID NO: 98836 - DNA, 22 bp, Artificial Sequence
  Synthetic
cgagaggcaugagaaggttcut

SEQ ID NO: 98837 - DNA, 25 bp, Artificial Sequence
  Synthetic
gtcaauggaggagaaagtgugaact

SEQ ID NO: 98838 - DNA, 19 bp, Artificial Sequence
  Synthetic
gcggttugtcccgucaaag

SEQ ID NO: 98839 - DNA, 24 bp, Artificial Sequence
  Synthetic
tggccattguccccatttttctua

SEQ ID NO: 98840 - DNA, 25 bp, Artificial Sequence
  Synthetic
agttcttugagcttttcctuaggca

SEQ ID NO: 98841 - DNA, 27 bp, Artificial Sequence
  Synthetic
tgagcagtggucattttatgaaucagt

SEQ ID NO: 98842 - DNA, 23 bp, Artificial Sequence
  Synthetic
aaccttgcctutgtgtagagcut

SEQ ID NO: 98843 - DNA, 24 bp, Artificial Sequence
  Synthetic
tgtaatcaugccaacatccugacc

SEQ ID NO: 98844 - DNA, 27 bp, Artificial Sequence
  Synthetic
cggcgaagattuaaagagattgcctua

SEQ ID NO: 98845 - DNA, 27 bp, Artificial Sequence
  Synthetic
acagacaaacaugttcatttcucacct

SEQ ID NO: 98846 - DNA, 20 bp, Artificial Sequence
  Synthetic
actugcttgaagugcgaggt

SEQ ID NO: 98847 - DNA, 28 bp, Artificial Sequence
  Synthetic
cgtaggttgtgcaucagtaagctattut

SEQ ID NO: 98848 - DNA, 21 bp, Artificial Sequence
  Synthetic
gaaggttctuggatcgggcut

SEQ ID NO: 98849 - DNA, 28 bp, Artificial Sequence
  Synthetic
agccttggaaucctttctctagaacuat

SEQ ID NO: 98850 - DNA, 23 bp, Artificial Sequence
  Synthetic
agttgggagaccaugcaguaaag

SEQ ID NO: 98851 - DNA, 23 bp, Artificial Sequence
  Synthetic
ggattaaagcucaggtccaggut

SEQ ID NO: 98852 - DNA, 28 bp, Artificial Sequence
  Synthetic
aaaattttaccaugaggcttgtgugaaa

SEQ ID NO: 98853 - DNA, 20 bp, Artificial Sequence
  Synthetic
gcaucugaacccacagcaag

SEQ ID NO: 98854 - DNA, 23 bp, Artificial Sequence
  Synthetic
ctctcaccauagttccccucaga

SEQ ID NO: 98855 - DNA, 26 bp, Artificial Sequence
  Synthetic
cagagctaagugataacaccagguat

SEQ ID NO: 98856 - DNA, 18 bp, Artificial Sequence
  Synthetic
gcagccucaccccacuaa

SEQ ID NO: 98857 - DNA, 20 bp, Artificial Sequence
  Synthetic
agttcagcauccgcuaccag

SEQ ID NO: 98858 - DNA, 22 bp, Artificial Sequence
  Synthetic
caaccuccccttcucaaccaag

SEQ ID NO: 98859 - DNA, 28 bp, Artificial Sequence
  Synthetic
cttgtgcagtaugtaaaagtggatucat

SEQ ID NO: 98860 - DNA, 26 bp, Artificial Sequence
  Synthetic
gagcatacagtauttgtttggctgut

SEQ ID NO: 98861 - DNA, 26 bp, Artificial Sequence
  Synthetic
acctctgaaacaautgctgacatuca

SEQ ID NO: 98862 - DNA, 21 bp, Artificial Sequence
  Synthetic
agcagccacautgctactgut

SEQ ID NO: 98863 - DNA, 25 bp, Artificial Sequence
  Synthetic
tttttccttccaggaugttgcctua

SEQ ID NO: 98864 - DNA, 24 bp, Artificial Sequence
  Synthetic
cggaaccacucgagagaaaaaguc

SEQ ID NO: 98865 - DNA, 26 bp, Artificial Sequence
  Synthetic
atcattctucaagattcgtcaugggt

SEQ ID NO: 98866 - DNA, 19 bp, Artificial Sequence
  Synthetic
ccagcccugctucaaccaa

SEQ ID NO: 98867 - DNA, 18 bp, Artificial Sequence
  Synthetic
cagcagcuccaggtccuc

SEQ ID NO: 98868 - DNA, 17 bp, Artificial Sequence
  Synthetic
ccaguaccgcgctcugt

SEQ ID NO: 98869 - DNA, 17 bp, Artificial Sequence
  Synthetic
gcauccagcccacgcuc

SEQ ID NO: 98870 - DNA, 24 bp, Artificial Sequence
  Synthetic
ccaaccaaguaccauacacccaaa

SEQ ID NO: 98871 - DNA, 21 bp, Artificial Sequence
  Synthetic
cugccgagagatttucccaca

SEQ ID NO: 98872 - DNA, 21 bp, Artificial Sequence
  Synthetic
cagtaaggcugccagcagaua

SEQ ID NO: 98873 - DNA, 22 bp, Artificial Sequence
  Synthetic
cctgtacccutgcctttgaucc

SEQ ID NO: 98874 - DNA, 25 bp, Artificial Sequence
  Synthetic
tgacagcaguaattttggcagugat

SEQ ID NO: 98875 - DNA, 28 bp, Artificial Sequence
  Synthetic
ctgtautgaaagaaatctuggacaggga

SEQ ID NO: 98876 - DNA, 25 bp, Artificial Sequence
  Synthetic
autttcacacagtugagacaaggga

SEQ ID NO: 98877 - DNA, 22 bp, Artificial Sequence
  Synthetic
tgaaagttcgcugtggtgttug

SEQ ID NO: 98878 - DNA, 26 bp, Artificial Sequence
  Synthetic
aaggaggccaacuaaaaggataaaut

SEQ ID NO: 98879 - DNA, 25 bp, Artificial Sequence
  Synthetic
cccaatggcutatcttacacuggat

SEQ ID NO: 98880 - DNA, 28 bp, Artificial Sequence
  Synthetic
gaaagtactccttuacctgtagttggug

SEQ ID NO: 98881 - DNA, 27 bp, Artificial Sequence
  Synthetic
attcatgctttcutgctgttcgttuat

SEQ ID NO: 98882 - DNA, 25 bp, Artificial Sequence
  Synthetic
tccacttaaaccauacatgcgtugt

SEQ ID NO: 98883 - DNA, 23 bp, Artificial Sequence
  Synthetic
gcccccgtauaactccattctug

SEQ ID NO: 98884 - DNA, 27 bp, Artificial Sequence
  Synthetic
gattatccttacutggaaagctgucgt

SEQ ID NO: 98885 - DNA, 28 bp, Artificial Sequence
  Synthetic
ttctggattttgugggtagagctaaaut

SEQ ID NO: 98886 - DNA, 25 bp, Artificial Sequence
  Synthetic
ggaagutatggactuggaggagaga

SEQ ID NO: 98887 - DNA, 27 bp, Artificial Sequence
  Synthetic
tttgtaaataugggaagaacugcaggt

SEQ ID NO: 98888 - DNA, 20 bp, Artificial Sequence
  Synthetic
ccgctccugaagaaaugcac

SEQ ID NO: 98889 - DNA, 21 bp, Artificial Sequence
  Synthetic
gccgactcucaccatcaucaa

SEQ ID NO: 98890 - DNA, 23 bp, Artificial Sequence
  Synthetic
gggaaaagcuccagatcgactut

SEQ ID NO: 98891 - DNA, 21 bp, Artificial Sequence
  Synthetic
gtcccctuccccctgttacua

SEQ ID NO: 98892 - DNA, 26 bp, Artificial Sequence
  Synthetic
cttttagaggacaugctcatcctuca

SEQ ID NO: 98893 - DNA, 27 bp, Artificial Sequence
  Synthetic
ctctgacattuatttccacattcugct

SEQ ID NO: 98894 - DNA, 21 bp, Artificial Sequence
  Synthetic
tgcautcaauaagggcaggga

SEQ ID NO: 98895 - DNA, 28 bp, Artificial Sequence
  Synthetic
cctctccagcugaaaccaaatatuacaa

SEQ ID NO: 98896 - DNA, 24 bp, Artificial Sequence
  Synthetic
agacautcattugaaagcgggaga

SEQ ID NO: 98897 - DNA, 27 bp, Artificial Sequence
  Synthetic
ccccagatgucaagctacaaaauacat

SEQ ID NO: 98898 - DNA, 20 bp, Artificial Sequence
  Synthetic
cacgaccaaugggaaccuga

SEQ ID NO: 98899 - DNA, 21 bp, Artificial Sequence
  Synthetic
ctaccuggaccaguccaacac

SEQ ID NO: 98900 - DNA, 28 bp, Artificial Sequence
  Synthetic
gtcctttttgauttttagtgguccagat

SEQ ID NO: 98901 - DNA, 21 bp, Artificial Sequence
  Synthetic
agttccacaugagggcgatut

SEQ ID NO: 98902 - DNA, 25 bp, Artificial Sequence
  Synthetic
gggaatatgugactgcttcctuaca

SEQ ID NO: 98903 - DNA, 28 bp, Artificial Sequence
  Synthetic
cgcagatcaucaccatgtttaaagauaa

SEQ ID NO: 98904 - DNA, 24 bp, Artificial Sequence
  Synthetic
ggttttagtugcaccatccugaaa

SEQ ID NO: 98905 - DNA, 30 bp, Artificial Sequence
  Synthetic
gataacttgtuaaatggaaatctucacgct

SEQ ID NO: 98906 - DNA, 26 bp, Artificial Sequence
  Synthetic
tgtctcattuggtacagaatgtugct

SEQ ID NO: 98907 - DNA, 21 bp, Artificial Sequence
  Synthetic
catcugccagaccttguaccc

SEQ ID NO: 98908 - DNA, 20 bp, Artificial Sequence
  Synthetic
caggaggugtctugcggaat

SEQ ID NO: 98909 - DNA, 28 bp, Artificial Sequence
  Synthetic
gtgtgccataugaaacttccaatuaagt

SEQ ID NO: 98910 - DNA, 21 bp, Artificial Sequence
  Synthetic
aggctatgcauctccccucat

SEQ ID NO: 98911 - DNA, 25 bp, Artificial Sequence
  Synthetic
tccgtgtgtacucttcataaagcug

SEQ ID NO: 98912 - DNA, 27 bp, Artificial Sequence
  Synthetic
cagccctaucaaatgaaacaatuggaa

SEQ ID NO: 98913 - DNA, 27 bp, Artificial Sequence
  Synthetic
cagtaggagaaagcaugtttttgaugt

SEQ ID NO: 98914 - DNA, 20 bp, Artificial Sequence
  Synthetic
cctgtaggccucgaagguga

SEQ ID NO: 98915 - DNA, 21 bp, Artificial Sequence
  Synthetic
ccgccuggttcuaacacacat

SEQ ID NO: 98916 - DNA, 27 bp, Artificial Sequence
  Synthetic
ctggaactcacauaactcttgtguact

SEQ ID NO: 98917 - DNA, 26 bp, Artificial Sequence
  Synthetic
acatggagacauccaagtgataccua

SEQ ID NO: 98918 - DNA, 20 bp, Artificial Sequence
  Synthetic
gccaucgccccattggaaut

SEQ ID NO: 98919 - DNA, 29 bp, Artificial Sequence
  Synthetic
gcttccagagcaccauaataaatagttuc

SEQ ID NO: 98920 - DNA, 22 bp, Artificial Sequence
  Synthetic
tcuggtaacattcuccccacca

SEQ ID NO: 98921 - DNA, 26 bp, Artificial Sequence
  Synthetic
tttccagacugctgacaaattguact

SEQ ID NO: 98922 - DNA, 19 bp, Artificial Sequence
  Synthetic
cagggaccaaucccaggug

SEQ ID NO: 98923 - DNA, 28 bp, Artificial Sequence
  Synthetic
cctggcttcuaggtttctaattctgaut

SEQ ID NO: 98924 - DNA, 20 bp, Artificial Sequence
  Synthetic
acaagagccgcgaguaugac

SEQ ID NO: 98925 - DNA, 26 bp, Artificial Sequence
  Synthetic
gcaactggatautcatcctcaagucc

SEQ ID NO: 98926 - DNA, 27 bp, Artificial Sequence
  Synthetic
gggtcttttccuagtttgctattauca

SEQ ID NO: 98927 - DNA, 29 bp, Artificial Sequence
  Synthetic
tctttgttcctuccctatctgttcatuac

SEQ ID NO: 98928 - DNA, 17 bp, Artificial Sequence
  Synthetic
gggccguggaggcttut

SEQ ID NO: 98929 - DNA, 18 bp, Artificial Sequence
  Synthetic
tgtgggcuagcgtgaugg

SEQ ID NO: 98930 - DNA, 23 bp, Artificial Sequence
  Synthetic
ccgtaccaucttgaagccttuga

SEQ ID NO: 98931 - DNA, 20 bp, Artificial Sequence
  Synthetic
gutcagcaacaucccggaga

SEQ ID NO: 98932 - DNA, 19 bp, Artificial Sequence
  Synthetic
ccaucacgcuagcccacag

SEQ ID NO: 98933 - DNA, 18 bp, Artificial Sequence
  Synthetic
cgggugagguaccaggaa

SEQ ID NO: 98934 - DNA, 28 bp, Artificial Sequence
  Synthetic
cagtagattugactagtttcaucccaga

SEQ ID NO: 98935 - DNA, 24 bp, Artificial Sequence
  Synthetic
caaaagcuacgaggctcttcucaa

SEQ ID NO: 98936 - DNA, 26 bp, Artificial Sequence
  Synthetic
tctacagcaaatutccaagagagcut

SEQ ID NO: 98937 - DNA, 22 bp, Artificial Sequence
  Synthetic
ccaggacacucattuggacaca

SEQ ID NO: 98938 - DNA, 27 bp, Artificial Sequence
  Synthetic
gcccagttacugaataagcagatctut

SEQ ID NO: 98939 - DNA, 28 bp, Artificial Sequence
  Synthetic
cacaggcaaaaacaautccatccataua

SEQ ID NO: 98940 - DNA, 22 bp, Artificial Sequence
  Synthetic
gccccagaaagagcutggauat

SEQ ID NO: 98941 - DNA, 28 bp, Artificial Sequence
  Synthetic
ggtctaaaaguagactgaagggtcauct

SEQ ID NO: 98942 - DNA, 24 bp, Artificial Sequence
  Synthetic
gagtctaattttucccctggguca

SEQ ID NO: 98943 - DNA, 28 bp, Artificial Sequence
  Synthetic
atgtgtgaaucagactgctgtataugag

SEQ ID NO: 98944 - DNA, 27 bp, Artificial Sequence
  Synthetic
cctttccttttuaggactggtcttuga

SEQ ID NO: 98945 - DNA, 25 bp, Artificial Sequence
  Synthetic
ttggaccccugaaauaagagaaacc

SEQ ID NO: 98946 - DNA, 21 bp, Artificial Sequence
  Synthetic
gtgtctucccaaagggtcuga

SEQ ID NO: 98947 - DNA, 26 bp, Artificial Sequence
  Synthetic
gcagatgucccactattaacuccaag

SEQ ID NO: 98948 - DNA, 21 bp, Artificial Sequence
  Synthetic
ggcctactuccctctctcuga

SEQ ID NO: 98949 - DNA, 17 bp, Artificial Sequence
  Synthetic
cuccccacaggcguaca

SEQ ID NO: 98950 - DNA, 26 bp, Artificial Sequence
  Synthetic
acagagtctucgtgtttcatctucaa

SEQ ID NO: 98951 - DNA, 27 bp, Artificial Sequence
  Synthetic
gttatggaagcaagutcacaatuaccc

SEQ ID NO: 98952 - DNA, 18 bp, Artificial Sequence
  Synthetic
cacccugagccccaucaa

SEQ ID NO: 98953 - DNA, 19 bp, Artificial Sequence
  Synthetic
cggugaggagaagcucaca

SEQ ID NO: 98954 - DNA, 28 bp, Artificial Sequence
  Synthetic
tctccaccautaatgtagtcuaggacaa

SEQ ID NO: 98955 - DNA, 26 bp, Artificial Sequence
  Synthetic
acatgccacuaaatctgaatcgucat

SEQ ID NO: 98956 - DNA, 27 bp, Artificial Sequence
  Synthetic
aatgcttgagacaucatttctttgcug

SEQ ID NO: 98957 - DNA, 23 bp, Artificial Sequence
  Synthetic
cttgccttctuacagcccattug

SEQ ID NO: 98958 - DNA, 28 bp, Artificial Sequence
  Synthetic
ttttggcttcttuactatcctggtctuc

SEQ ID NO: 98959 - DNA, 28 bp, Artificial Sequence
  Synthetic
catgtggtttuagaagtacccctcttut

SEQ ID NO: 98960 - DNA, 20 bp, Artificial Sequence
  Synthetic
ccccugtagcagucagagga

SEQ ID NO: 98961 - DNA, 27 bp, Artificial Sequence
  Synthetic
ggttacaagagcaugtagtatgtguct

SEQ ID NO: 98962 - DNA, 21 bp, Artificial Sequence
  Synthetic
tggaaccuaaccctucccact

SEQ ID NO: 98963 - DNA, 21 bp, Artificial Sequence
  Synthetic
gcatccccucaccttcctuct

SEQ ID NO: 98964 - DNA, 23 bp, Artificial Sequence
  Synthetic
ggcgtcaggaauttcagccaaua

SEQ ID NO: 98965 - DNA, 19 bp, Artificial Sequence
  Synthetic
gcttccaaucctgctcguc

SEQ ID NO: 98966 - DNA, 21 bp, Artificial Sequence
  Synthetic
ctcagaucactgaugggcagt

SEQ ID NO: 98967 - DNA, 21 bp, Artificial Sequence
  Synthetic
gcttgccugcctgacatcuat

SEQ ID NO: 98968 - DNA, 27 bp, Artificial Sequence
  Synthetic
caatgacaggutattggucaacacaag

SEQ ID NO: 98969 - DNA, 24 bp, Artificial Sequence
  Synthetic
ttaccttaacutccacatgugcca

SEQ ID NO: 98970 - DNA, 24 bp, Artificial Sequence
  Synthetic
tccagtgaaacugcatcatcucaa

SEQ ID NO: 98971 - DNA, 21 bp, Artificial Sequence
  Synthetic
cctgtgaucgaaagtctgcug

SEQ ID NO: 98972 - DNA, 20 bp, Artificial Sequence
  Synthetic
cutaccauccacggcaagga

SEQ ID NO: 98973 - DNA, 22 bp, Artificial Sequence
  Synthetic
catgctggaugtttgcctcuac

SEQ ID NO: 98974 - DNA, 23 bp, Artificial Sequence
  Synthetic
gtttgatctgugcaatgcctcut

SEQ ID NO: 98975 - DNA, 28 bp, Artificial Sequence
  Synthetic
aattagagttaaguagggaccaucccat

SEQ ID NO: 98976 - DNA, 24 bp, Artificial Sequence
  Synthetic
cacaccccuaagtgagtgatctut

SEQ ID NO: 98977 - DNA, 20 bp, Artificial Sequence
  Synthetic
ggcgaggacuacuccaaagg

SEQ ID NO: 98978 - DNA, 28 bp, Artificial Sequence
  Synthetic
aattagtgcuaactagtttcagugaaca

SEQ ID NO: 98979 - DNA, 26 bp, Artificial Sequence
  Synthetic
gcctgctctutagtggaaactaugaa

SEQ ID NO: 98980 - DNA, 28 bp, Artificial Sequence
  Synthetic
ctgtgaaagcgaacaauatctccattut

SEQ ID NO: 98981 - DNA, 27 bp, Artificial Sequence
  Synthetic
gtgttttccagautattgctcagtugt

SEQ ID NO: 98982 - DNA, 28 bp, Artificial Sequence
  Synthetic
agttagttttacauttgtctgguccaca

SEQ ID NO: 98983 - DNA, 28 bp, Artificial Sequence
  Synthetic
ggaagaataagguttggtgtttugaagt

SEQ ID NO: 98984 - DNA, 21 bp, Artificial Sequence
  Synthetic
gguccactgctucaggagaac

SEQ ID NO: 98985 - DNA, 22 bp, Artificial Sequence
  Synthetic
ggctcacugatgcugacaagaa

SEQ ID NO: 98986 - DNA, 22 bp, Artificial Sequence
  Synthetic
gggtuaacaaggagcctggtut

SEQ ID NO: 98987 - DNA, 22 bp, Artificial Sequence
  Synthetic
ccgaagagcucacttcuccaag

SEQ ID NO: 98988 - DNA, 18 bp, Artificial Sequence
  Synthetic
cacacccccucctccuca

SEQ ID NO: 98989 - DNA, 20 bp, Artificial Sequence
  Synthetic
gggcaugaaggacuccaagt

SEQ ID NO: 98990 - DNA, 23 bp, Artificial Sequence
  Synthetic
ggaacaccgaccucacagtttut

SEQ ID NO: 98991 - DNA, 27 bp, Artificial Sequence
  Synthetic
tgggcaagtcuttgattttgatacuga

SEQ ID NO: 98992 - DNA, 20 bp, Artificial Sequence
  Synthetic
gcagaaucggcaaacucagg

SEQ ID NO: 98993 - DNA, 20 bp, Artificial Sequence
  Synthetic
cuccaccagaccaggguact

SEQ ID NO: 98994 - DNA, 21 bp, Artificial Sequence
  Synthetic
ccttccacuccagaggacuga

SEQ ID NO: 98995 - DNA, 22 bp, Artificial Sequence
  Synthetic
gccatgguaaggatggatgcut

SEQ ID NO: 98996 - DNA, 23 bp, Artificial Sequence
  Synthetic
tcacctccgaguggcagtaauat

SEQ ID NO: 98997 - DNA, 21 bp, Artificial Sequence
  Synthetic
cagcacucccttgaggguaag

SEQ ID NO: 98998 - DNA, 19 bp, Artificial Sequence
  Synthetic
cctgcgccguggagaauac

SEQ ID NO: 98999 - DNA, 21 bp, Artificial Sequence
  Synthetic
ggguggcagtaattguccaga

SEQ ID NO: 99000 - DNA, 25 bp, Artificial Sequence
  Synthetic
gagtgaattttugcggtctcatgut

SEQ ID NO: 99001 - DNA, 28 bp, Artificial Sequence
  Synthetic
gtcctcatttatcutaacagcttccuct

SEQ ID NO: 99002 - DNA, 22 bp, Artificial Sequence
  Synthetic
agacgatgagguggaagaggua

SEQ ID NO: 99003 - DNA, 26 bp, Artificial Sequence
  Synthetic
cctgacctgcuccctttcttttauag

SEQ ID NO: 99004 - DNA, 21 bp, Artificial Sequence
  Synthetic
tgtggaaugtgtggctugagt

SEQ ID NO: 99005 - DNA, 22 bp, Artificial Sequence
  Synthetic
gagaagcugaactttgccctug

SEQ ID NO: 99006 - DNA, 26 bp, Artificial Sequence
  Synthetic
gagaactcaatguccatctccatuct

SEQ ID NO: 99007 - DNA, 23 bp, Artificial Sequence
  Synthetic
agggttaaguggatcagtggcua

SEQ ID NO: 99008 - DNA, 19 bp, Artificial Sequence
  Synthetic
cctccccaaaugcgaugct

SEQ ID NO: 99009 - DNA, 21 bp, Artificial Sequence
  Synthetic
agcuctaccgaaucaggacca

SEQ ID NO: 99010 - DNA, 20 bp, Artificial Sequence
  Synthetic
ggcagugagcgtggagtuaa

SEQ ID NO: 99011 - DNA, 19 bp, Artificial Sequence
  Synthetic
gcucccacaggaagaggug

SEQ ID NO: 99012 - DNA, 23 bp, Artificial Sequence
  Synthetic
tcacagaagcagugaggatgaug

SEQ ID NO: 99013 - DNA, 24 bp, Artificial Sequence
  Synthetic
cagaagugagggaaagtucagagg

SEQ ID NO: 99014 - DNA, 17 bp, Artificial Sequence
  Synthetic
ccgagggcaggucucca

SEQ ID NO: 99015 - DNA, 18 bp, Artificial Sequence
  Synthetic
ctctgccuggctgtucca

SEQ ID NO: 99016 - DNA, 23 bp, Artificial Sequence
  Synthetic
catggaacauctgatcacugggt

SEQ ID NO: 99017 - DNA, 22 bp, Artificial Sequence
  Synthetic
ctgggaggaggaguacgaugaa

SEQ ID NO: 99018 - DNA, 28 bp, Artificial Sequence
  Synthetic
gtatcctttctccucatctctagcauct

SEQ ID NO: 99019 - DNA, 24 bp, Artificial Sequence
  Synthetic
agcaacaaaacaauatgcctuggg

SEQ ID NO: 99020 - DNA, 22 bp, Artificial Sequence
  Synthetic
gagccctgagucctaataccug

SEQ ID NO: 99021 - DNA, 18 bp, Artificial Sequence
  Synthetic
cccctguccagctgtuga

SEQ ID NO: 99022 - DNA, 27 bp, Artificial Sequence
  Synthetic
ctgacctctucaccatttttctttcug

SEQ ID NO: 99023 - DNA, 20 bp, Artificial Sequence
  Synthetic
ttcggaaaagcucuggccat

SEQ ID NO: 99024 - DNA, 22 bp, Artificial Sequence
  Synthetic
ggtgctcaggaugcatttgtut

SEQ ID NO: 99025 - DNA, 23 bp, Artificial Sequence
  Synthetic
cagcaaccuaccttgaaatgucc

SEQ ID NO: 99026 - DNA, 22 bp, Artificial Sequence
  Synthetic
cggacttagacutgagcaggug

SEQ ID NO: 99027 - DNA, 24 bp, Artificial Sequence
  Synthetic
ccccaaccuccttacaagacttug

SEQ ID NO: 99028 - DNA, 28 bp, Artificial Sequence
  Synthetic
atgttggccaagaugaaatttagcttut

SEQ ID NO: 99029 - DNA, 29 bp, Artificial Sequence
  Synthetic
gttttctgggcucttggaatatcttauca

SEQ ID NO: 99030 - DNA, 21 bp, Artificial Sequence
  Synthetic
tggaatcauggccagagctut

SEQ ID NO: 99031 - DNA, 31 bp, Artificial Sequence
  Synthetic
cctttggaatguaatataggtgttctucaca

SEQ ID NO: 99032 - DNA, 20 bp, Artificial Sequence
  Synthetic
ggcattgucctcatccucgt

SEQ ID NO: 99033 - DNA, 21 bp, Artificial Sequence
  Synthetic
cccugaccagggtatcttucc

SEQ ID NO: 99034 - DNA, 21 bp, Artificial Sequence
  Synthetic
gcaggatgcugagtggtacug

SEQ ID NO: 99035 - DNA, 21 bp, Artificial Sequence
  Synthetic
ccctgugggaacauccaacat

SEQ ID NO: 99036 - DNA, 20 bp, Artificial Sequence
  Synthetic
caagcaatuggaggcgauca

SEQ ID NO: 99037 - DNA, 28 bp, Artificial Sequence
  Synthetic
gtccccatttcacugaactaaatagcut

SEQ ID NO: 99038 - DNA, 21 bp, Artificial Sequence
  Synthetic
agagtcccccagutctgaguc

SEQ ID NO: 99039 - DNA, 24 bp, Artificial Sequence
  Synthetic
ttggtcttcucccttcccagauat

SEQ ID NO: 99040 - DNA, 28 bp, Artificial Sequence
  Synthetic
catagtgcttauagcatcctcttgacut

SEQ ID NO: 99041 - DNA, 25 bp, Artificial Sequence
  Synthetic
cacaggtctuggatcaaagtucagt

SEQ ID NO: 99042 - DNA, 27 bp, Artificial Sequence
  Synthetic
tcacattugaacagtcattctugagga

SEQ ID NO: 99043 - DNA, 28 bp, Artificial Sequence
  Synthetic
caaggaagtguccagtatgaataaguga

SEQ ID NO: 99044 - DNA, 21 bp, Artificial Sequence
  Synthetic
ccacagaaacgugcagaugga

SEQ ID NO: 99045 - DNA, 22 bp, Artificial Sequence
  Synthetic
gggcacctucaaggactatgug

SEQ ID NO: 99046 - DNA, 25 bp, Artificial Sequence
  Synthetic
ctcctgcatcuctctacttgaagug

SEQ ID NO: 99047 - DNA, 23 bp, Artificial Sequence
  Synthetic
tccugcuaaaacccaggaacaat

SEQ ID NO: 99048 - DNA, 28 bp, Artificial Sequence
  Synthetic
gagttttggccucttcattttgctuaat

SEQ ID NO: 99049 - DNA, 29 bp, Artificial Sequence
  Synthetic
gggatccaaacaaugaatataaatuagcc

SEQ ID NO: 99050 - DNA, 21 bp, Artificial Sequence
  Synthetic
tgtcccauacccagtcctuga

SEQ ID NO: 99051 - DNA, 28 bp, Artificial Sequence
  Synthetic
agtttuacttcttgatcugggaaacaca

SEQ ID NO: 99052 - DNA, 26 bp, Artificial Sequence
  Synthetic
attcattgtttggaucccctggaaua

SEQ ID NO: 99053 - DNA, 25 bp, Artificial Sequence
  Synthetic
caaggagagauagaagttgggctut

SEQ ID NO: 99054 - DNA, 20 bp, Artificial Sequence
  Synthetic
gaggcacuagctctgccaut

SEQ ID NO: 99055 - DNA, 20 bp, Artificial Sequence
  Synthetic
agaccuctcucagcaccact

SEQ ID NO: 99056 - DNA, 21 bp, Artificial Sequence
  Synthetic
tgagaatguttaccgcuggca

SEQ ID NO: 99057 - DNA, 28 bp, Artificial Sequence
  Synthetic
cgtttctttattuctcctccttcaucca

SEQ ID NO: 99058 - DNA, 26 bp, Artificial Sequence
  Synthetic
cttgtattcaagguctggctggttua

SEQ ID NO: 99059 - DNA, 27 bp, Artificial Sequence
  Synthetic
tgctaatcggaautcttcaatggucaa

SEQ ID NO: 99060 - DNA, 21 bp, Artificial Sequence
  Synthetic
ccutattgaggucagcacggt

SEQ ID NO: 99061 - DNA, 22 bp, Artificial Sequence
  Synthetic
gcagccagucatcttucaacag

SEQ ID NO: 99062 - DNA, 28 bp, Artificial Sequence
  Synthetic
gctgatattcaugctttaaacgttguct

SEQ ID NO: 99063 - DNA, 24 bp, Artificial Sequence
  Synthetic
cacattccugctgtctcaguacaa

SEQ ID NO: 99064 - DNA, 17 bp, Artificial Sequence
  Synthetic
gtgggcguggcagauga

SEQ ID NO: 99065 - DNA, 18 bp, Artificial Sequence
  Synthetic
tgggcugactctgcucct

SEQ ID NO: 99066 - DNA, 25 bp, Artificial Sequence
  Synthetic
agtatgcutcaaggaugacaccaaa

SEQ ID NO: 99067 - DNA, 28 bp, Artificial Sequence
  Synthetic
acacaatgacctugccatcataagttua

SEQ ID NO: 99068 - DNA, 20 bp, Artificial Sequence
  Synthetic
ctcuagagggcctgugcaat

SEQ ID NO: 99069 - DNA, 27 bp, Artificial Sequence
  Synthetic
tttacccttucaatagtcacacucacc

SEQ ID NO: 99070 - DNA, 25 bp, Artificial Sequence
  Synthetic
tgtttcttcautttccctggugagt

SEQ ID NO: 99071 - DNA, 23 bp, Artificial Sequence
  Synthetic
ttcccaccuttgttggaagugaa

SEQ ID NO: 99072 - DNA, 25 bp, Artificial Sequence
  Synthetic
cctuaagcacccaaaagcataucct

SEQ ID NO: 99073 - DNA, 22 bp, Artificial Sequence
  Synthetic
gagcugcattgtuaacccaaca

SEQ ID NO: 99074 - DNA, 21 bp, Artificial Sequence
  Synthetic
tgucauaggagggaacacgct

SEQ ID NO: 99075 - DNA, 24 bp, Artificial Sequence
  Synthetic
gtcctcttccuacctcctccttua

SEQ ID NO: 99076 - DNA, 24 bp, Artificial Sequence
  Synthetic
gggtcauccacagaggacaguaat

SEQ ID NO: 99077 - DNA, 28 bp, Artificial Sequence
  Synthetic
gcaggttagaccutgacagtgaaaaaua

SEQ ID NO: 99078 - DNA, 29 bp, Artificial Sequence
  Synthetic
tgaaactcaaatcuctcaaaaggctuact

SEQ ID NO: 99079 - DNA, 23 bp, Artificial Sequence
  Synthetic
gctggttgucccaaaatcactut

SEQ ID NO: 99080 - DNA, 22 bp, Artificial Sequence
  Synthetic
tctgggaucaaagtgcttugga

SEQ ID NO: 99081 - DNA, 25 bp, Artificial Sequence
  Synthetic
ccattgauaacaccaacatccccua

SEQ ID NO: 99082 - DNA, 26 bp, Artificial Sequence
  Synthetic
caacgaaaaatcugtctgatgcaugt

SEQ ID NO: 99083 - DNA, 27 bp, Artificial Sequence
  Synthetic
ttcataccaaugccatggttatcgtua

SEQ ID NO: 99084 - DNA, 26 bp, Artificial Sequence
  Synthetic
cttgagtttcaaaggutgctgttcuc

SEQ ID NO: 99085 - DNA, 27 bp, Artificial Sequence
  Synthetic
gaatgctggaaauccagatgttcuagt

SEQ ID NO: 99086 - DNA, 25 bp, Artificial Sequence
  Synthetic
ccaggaactuggatcaaagggttua

SEQ ID NO: 99087 - DNA, 23 bp, Artificial Sequence
  Synthetic
gcaaacctucactttccaagugt

SEQ ID NO: 99088 - DNA, 24 bp, Artificial Sequence
  Synthetic
tgagctggagaauttggattgugt

SEQ ID NO: 99089 - DNA, 21 bp, Artificial Sequence
  Synthetic
cagaacaugcctcaagugcat

SEQ ID NO: 99090 - DNA, 27 bp, Artificial Sequence
  Synthetic
attgtctacttutgttcctaccugcaa

SEQ ID NO: 99091 - DNA, 25 bp, Artificial Sequence
  Synthetic
aatggaactcuctgtactttugcca

SEQ ID NO: 99092 - DNA, 20 bp, Artificial Sequence
  Synthetic
gggtagguccttcugccaac

SEQ ID NO: 99093 - DNA, 21 bp, Artificial Sequence
  Synthetic
gacuggcugcagaaacacaac

SEQ ID NO: 99094 - DNA, 21 bp, Artificial Sequence
  Synthetic
cctgcgaacacautgctguag

SEQ ID NO: 99095 - DNA, 28 bp, Artificial Sequence
  Synthetic
tccaatcauaagggacagtaactgguat

SEQ ID NO: 99096 - DNA, 28 bp, Artificial Sequence
  Synthetic
tcttcactttgcugttgagattcttuga

SEQ ID NO: 99097 - DNA, 29 bp, Artificial Sequence
  Synthetic
agatacactgggucaagtctacaaaagua

SEQ ID NO: 99098 - DNA, 29 bp, Artificial Sequence
  Synthetic
tcatttggtgtggutttctgttctacaua

SEQ ID NO: 99099 - DNA, 28 bp, Artificial Sequence
  Synthetic
cacccagaucaaacaaaacacttagaut

SEQ ID NO: 99100 - DNA, 21 bp, Artificial Sequence
  Synthetic
ccagguatctctcugcccact

SEQ ID NO: 99101 - DNA, 22 bp, Artificial Sequence
  Synthetic
cacaaccctcucctgctttcuc

SEQ ID NO: 99102 - DNA, 28 bp, Artificial Sequence
  Synthetic
gatcaaactccaauacagcaaaccatut

SEQ ID NO: 99103 - DNA, 27 bp, Artificial Sequence
  Synthetic
aagagagggaccaaagutggttaaaut

SEQ ID NO: 99104 - DNA, 27 bp, Artificial Sequence
  Synthetic
aaagctgtagtcutttctaagcaguca

SEQ ID NO: 99105 - DNA, 26 bp, Artificial Sequence
  Synthetic
tgcatgcaataauctggtttttcauc

SEQ ID NO: 99106 - DNA, 24 bp, Artificial Sequence
  Synthetic
ccctaccttcucatactcgtccuc

SEQ ID NO: 99107 - DNA, 20 bp, Artificial Sequence
  Synthetic
ggaacgugacccccattuct

SEQ ID NO: 99108 - DNA, 28 bp, Artificial Sequence
  Synthetic
ctggguggcatttatttgtuacaagaat

SEQ ID NO: 99109 - DNA, 26 bp, Artificial Sequence
  Synthetic
gattttaaaacacuggcagaguccag

SEQ ID NO: 99110 - DNA, 20 bp, Artificial Sequence
  Synthetic
gggccuatggcaugaagaga

SEQ ID NO: 99111 - DNA, 24 bp, Artificial Sequence
  Synthetic
catgagtgaggagguaccacaaug

SEQ ID NO: 99112 - DNA, 27 bp, Artificial Sequence
  Synthetic
gctctgaattttucttctgctgcttut

SEQ ID NO: 99113 - DNA, 23 bp, Artificial Sequence
  Synthetic
ctcactattugtgcgagauggga

SEQ ID NO: 99114 - DNA, 28 bp, Artificial Sequence
  Synthetic
ccgttttcctcuatccaccatcttatut

SEQ ID NO: 99115 - DNA, 26 bp, Artificial Sequence
  Synthetic
agcgttggcaagacauttctacatua

SEQ ID NO: 99116 - DNA, 20 bp, Artificial Sequence
  Synthetic
ggagucagggccgagagaua

SEQ ID NO: 99117 - DNA, 27 bp, Artificial Sequence
  Synthetic
acccautatttacctuaaagccgaagt

SEQ ID NO: 99118 - DNA, 21 bp, Artificial Sequence
  Synthetic
ggcugaccaccagcatguaat

SEQ ID NO: 99119 - DNA, 22 bp, Artificial Sequence
  Synthetic
acacttgtgccutctgcttcuc

SEQ ID NO: 99120 - DNA, 28 bp, Artificial Sequence
  Synthetic
cctgaattcugctattatctaugaccga

SEQ ID NO: 99121 - DNA, 24 bp, Artificial Sequence
  Synthetic
ggtccauctcaacuccaaacaact

SEQ ID NO: 99122 - DNA, 24 bp, Artificial Sequence
  Synthetic
gagcattgccaaaguccttcttut

SEQ ID NO: 99123 - DNA, 28 bp, Artificial Sequence
  Synthetic
ggttttccccauttattgaagcatuaca

SEQ ID NO: 99124 - DNA, 19 bp, Artificial Sequence
  Synthetic
gtgcctutaccccucacga

SEQ ID NO: 99125 - DNA, 24 bp, Artificial Sequence
  Synthetic
ccttgctgcauttctcttgaguct

SEQ ID NO: 99126 - DNA, 25 bp, Artificial Sequence
  Synthetic
gtgcctaaatugtttgtagggtugg

SEQ ID NO: 99127 - DNA, 25 bp, Artificial Sequence
  Synthetic
caggauaggaagcacacatgucaat

SEQ ID NO: 99128 - DNA, 28 bp, Artificial Sequence
  Synthetic
cttcaactgctucatttccttcatctut

SEQ ID NO: 99129 - DNA, 28 bp, Artificial Sequence
  Synthetic
gttcttcgauactggtaugggaaaaagt

SEQ ID NO: 99130 - DNA, 28 bp, Artificial Sequence
  Synthetic
acaagatagctcauttttaggcaacuca

SEQ ID NO: 99131 - DNA, 28 bp, Artificial Sequence
  Synthetic
cuctctctttattaaugcccaggaaact

SEQ ID NO: 99132 - DNA, 24 bp, Artificial Sequence
  Synthetic
tatgcaucagtgttgttuggcaat

SEQ ID NO: 99133 - DNA, 22 bp, Artificial Sequence
  Synthetic
gcccccauatcuaagcaaagga

SEQ ID NO: 99134 - DNA, 26 bp, Artificial Sequence
  Synthetic
aagaacagaauggctctcttucaaca

SEQ ID NO: 99135 - DNA, 25 bp, Artificial Sequence
  Synthetic
ccgcagcauttccttuaaccaaaat

SEQ ID NO: 99136 - DNA, 24 bp, Artificial Sequence
  Synthetic
ggacttuttcctcctuccacacat

SEQ ID NO: 99137 - DNA, 28 bp, Artificial Sequence
  Synthetic
gggcaatauaaacatatgcatcguacaa

SEQ ID NO: 99138 - DNA, 28 bp, Artificial Sequence
  Synthetic
ggccttcaaugagactatcaagatctut

SEQ ID NO: 99139 - DNA, 21 bp, Artificial Sequence
  Synthetic
tgtacugcaccagaucagggt

SEQ ID NO: 99140 - DNA, 25 bp, Artificial Sequence
  Synthetic
acaagcgagagaacugattgauacc

SEQ ID NO: 99141 - DNA, 27 bp, Artificial Sequence
  Synthetic
catctggccagucctaagaatttcuaa

SEQ ID NO: 99142 - DNA, 27 bp, Artificial Sequence
  Synthetic
actccaccagutttaataccuaccagt

SEQ ID NO: 99143 - DNA, 28 bp, Artificial Sequence
  Synthetic
ctctttctttaggutccagcaacaaaut

SEQ ID NO: 99144 - DNA, 28 bp, Artificial Sequence
  Synthetic
gacaattguaccacccttaagttgatuc

SEQ ID NO: 99145 - DNA, 30 bp, Artificial Sequence
  Synthetic
aggataaaatagtuacatggatttgcugct

SEQ ID NO: 99146 - DNA, 28 bp, Artificial Sequence
  Synthetic
agcattttccaaguagtctagctttcut

SEQ ID NO: 99147 - DNA, 22 bp, Artificial Sequence
  Synthetic
atgccctgcutatctgaaggug

SEQ ID NO: 99148 - DNA, 26 bp, Artificial Sequence
  Synthetic
ggtactgagaucaaattctuggagga

SEQ ID NO: 99149 - DNA, 23 bp, Artificial Sequence
  Synthetic
aatacccatcacucccgctttut

SEQ ID NO: 99150 - DNA, 28 bp, Artificial Sequence
  Synthetic
ccaagaaagaaauatgcaattggtugct

SEQ ID NO: 99151 - DNA, 28 bp, Artificial Sequence
  Synthetic
gccagaaaaucaacaactagaucaacat

SEQ ID NO: 99152 - DNA, 24 bp, Artificial Sequence
  Synthetic
gggcacatucttgggaatuacaaa

SEQ ID NO: 99153 - DNA, 22 bp, Artificial Sequence
  Synthetic
ggcgaugaaggaggtgactuac

SEQ ID NO: 99154 - DNA, 22 bp, Artificial Sequence
  Synthetic
cttgacaucctcttctguggct

SEQ ID NO: 99155 - DNA, 27 bp, Artificial Sequence
  Synthetic
catccatagaccugacatgtgtaucat

SEQ ID NO: 99156 - DNA, 28 bp, Artificial Sequence
  Synthetic
cttgagcatacuctttcatttgtucaga

SEQ ID NO: 99157 - DNA, 28 bp, Artificial Sequence
  Synthetic
cctccagatuagtaaagccagtugaaaa

SEQ ID NO: 99158 - DNA, 21 bp, Artificial Sequence
  Synthetic
ggcagcauttgagagcugact

SEQ ID NO: 99159 - DNA, 23 bp, Artificial Sequence
  Synthetic
acacgtccaacucatgtgtacug

SEQ ID NO: 99160 - DNA, 20 bp, Artificial Sequence
  Synthetic
accgcgugaagaagctcauc

SEQ ID NO: 99161 - DNA, 21 bp, Artificial Sequence
  Synthetic
ggucgcacaaggagucaaact

SEQ ID NO: 99162 - DNA, 26 bp, Artificial Sequence
  Synthetic
tcagaagagaaguagaagtuccacca

SEQ ID NO: 99163 - DNA, 28 bp, Artificial Sequence
  Synthetic
aaatgaatgugagggtacactgtuagag

SEQ ID NO: 99164 - DNA, 26 bp, Artificial Sequence
  Synthetic
gaagaagctcaucaactcacagauca

SEQ ID NO: 99165 - DNA, 22 bp, Artificial Sequence
  Synthetic
cgaaagtcgutcacttcugggt

SEQ ID NO: 99166 - DNA, 28 bp, Artificial Sequence
  Synthetic
caagacttcucgaagctgatctttuagt

SEQ ID NO: 99167 - DNA, 26 bp, Artificial Sequence
  Synthetic
aatgcactgucaaaatccagucaaaa

SEQ ID NO: 99168 - DNA, 21 bp, Artificial Sequence
  Synthetic
ccgcaggcagacuctguaaat

SEQ ID NO: 99169 - DNA, 19 bp, Artificial Sequence
  Synthetic
cccttcuacctccggcuga

SEQ ID NO: 99170 - DNA, 25 bp, Artificial Sequence
  Synthetic
gaagttgaacgaauggaatgugcaa

SEQ ID NO: 99171 - DNA, 28 bp, Artificial Sequence
  Synthetic
acttauagaccagaactgcuacaacaga

SEQ ID NO: 99172 - DNA, 25 bp, Artificial Sequence
  Synthetic
cttctgccacutctaagttgaccua

SEQ ID NO: 99173 - DNA, 21 bp, Artificial Sequence
  Synthetic
attccttguggcagaguggag

SEQ ID NO: 99174 - DNA, 29 bp, Artificial Sequence
  Synthetic
gctgtagacuaaaatccaacttguaacga

SEQ ID NO: 99175 - DNA, 25 bp, Artificial Sequence
  Synthetic
cgtctgcaaugagtacaactgcuaa

SEQ ID NO: 99176 - DNA, 27 bp, Artificial Sequence
  Synthetic
agtcttcctcttutgatgccttgaaut

SEQ ID NO: 99177 - DNA, 28 bp, Artificial Sequence
  Synthetic
tctattggtttaucgactgtccttcuga

SEQ ID NO: 99178 - DNA, 21 bp, Artificial Sequence
  Synthetic
cctccacgaguttgactccut

SEQ ID NO: 99179 - DNA, 20 bp, Artificial Sequence
  Synthetic
gggaaacugtacugcagcca

SEQ ID NO: 99180 - DNA, 18 bp, Artificial Sequence
  Synthetic
ctggaagggucggcugaa

SEQ ID NO: 99181 - DNA, 19 bp, Artificial Sequence
  Synthetic
gtgacctgucccctccuct

SEQ ID NO: 99182 - DNA, 20 bp, Artificial Sequence
  Synthetic
tgugccaattcugcgaggag

SEQ ID NO: 99183 - DNA, 21 bp, Artificial Sequence
  Synthetic
cctcgcugccctcaaactuaa

SEQ ID NO: 99184 - DNA, 28 bp, Artificial Sequence
  Synthetic
cagagcagtcaugatatcttcttcctut

SEQ ID NO: 99185 - DNA, 28 bp, Artificial Sequence
  Synthetic
gaaatttcaagccaaugtatttctgcut

SEQ ID NO: 99186 - DNA, 18 bp, Artificial Sequence
  Synthetic
cgggcccutctggucaac

SEQ ID NO: 99187 - DNA, 20 bp, Artificial Sequence
  Synthetic
gacaccuggcaaacaccauc

SEQ ID NO: 99188 - DNA, 28 bp, Artificial Sequence
  Synthetic
gagctcaacutttagtgactuagaacct

SEQ ID NO: 99189 - DNA, 25 bp, Artificial Sequence
  Synthetic
gctccuaaagaccaaactgtgtcuc

SEQ ID NO: 99190 - DNA, 26 bp, Artificial Sequence
  Synthetic
ggttgagaugacaaaaagggtugaga

SEQ ID NO: 99191 - DNA, 18 bp, Artificial Sequence
  Synthetic
ggccaccaugggagagug

SEQ ID NO: 99192 - DNA, 24 bp, Artificial Sequence
  Synthetic
tgccattgatcucttcaaggctua

SEQ ID NO: 99193 - DNA, 28 bp, Artificial Sequence
  Synthetic
ctaccaggauctcaaaggaauggaaaat

SEQ ID NO: 99194 - DNA, 21 bp, Artificial Sequence
  Synthetic
tcctccuctctttcaguggct

SEQ ID NO: 99195 - DNA, 23 bp, Artificial Sequence
  Synthetic
acacacccaguctgttcttcauc

SEQ ID NO: 99196 - DNA, 24 bp, Artificial Sequence
  Synthetic
tgggtgcacacaaauacacaguat

SEQ ID NO: 99197 - DNA, 27 bp, Artificial Sequence
  Synthetic
aagagggaagtutttggtggtattuct

SEQ ID NO: 99198 - DNA, 19 bp, Artificial Sequence
  Synthetic
cctgccccugatggaacut

SEQ ID NO: 99199 - DNA, 21 bp, Artificial Sequence
  Synthetic
accttgtagucttcccuggca

SEQ ID NO: 99200 - DNA, 22 bp, Artificial Sequence
  Synthetic
ggtcctcagugtgcttgtagua

SEQ ID NO: 99201 - DNA, 23 bp, Artificial Sequence
  Synthetic
gctcattcctuacccagtccuca

SEQ ID NO: 99202 - DNA, 27 bp, Artificial Sequence
  Synthetic
gctttgaagtttcuctacgttccttut

SEQ ID NO: 99203 - DNA, 28 bp, Artificial Sequence
  Synthetic
cacatggaccagcuattcaaauagaaga

SEQ ID NO: 99204 - DNA, 17 bp, Artificial Sequence
  Synthetic
cgctgagugcagccgut

SEQ ID NO: 99205 - DNA, 19 bp, Artificial Sequence
  Synthetic
aggagugagggctctggut

SEQ ID NO: 99206 - DNA, 19 bp, Artificial Sequence
  Synthetic
gcagaggacugaccuccct

SEQ ID NO: 99207 - DNA, 20 bp, Artificial Sequence
  Synthetic
acctgcagcgugtagtctuc

SEQ ID NO: 99208 - DNA, 21 bp, Artificial Sequence
  Synthetic
agacccaccugaggacatuca

SEQ ID NO: 99209 - DNA, 18 bp, Artificial Sequence
  Synthetic
ctcaccuccgagcuggac

SEQ ID NO: 99210 - DNA, 26 bp, Artificial Sequence
  Synthetic
aatgaccttttgcuttgcttttccut

SEQ ID NO: 99211 - DNA, 27 bp, Artificial Sequence
  Synthetic
gttcatcgccuaactaattaactgcug

SEQ ID NO: 99212 - DNA, 20 bp, Artificial Sequence
  Synthetic
ggaagaaggccacagugtuc

SEQ ID NO: 99213 - DNA, 18 bp, Artificial Sequence
  Synthetic
agagugcagagggccuca

SEQ ID NO: 99214 - DNA, 27 bp, Artificial Sequence
  Synthetic
gctgtttuccgcaattctttgaauagt

SEQ ID NO: 99215 - DNA, 26 bp, Artificial Sequence
  Synthetic
ggaaattttgacugaacaagacguga

SEQ ID NO: 99216 - DNA, 21 bp, Artificial Sequence
  Synthetic
ccccaacagagcaucctagut

SEQ ID NO: 99217 - DNA, 29 bp, Artificial Sequence
  Synthetic
ctgcttgtcttccuattgatgatgtatug

SEQ ID NO: 99218 - DNA, 21 bp, Artificial Sequence
  Synthetic
gaggctcacauggtggtguaa

SEQ ID NO: 99219 - DNA, 25 bp, Artificial Sequence
  Synthetic
gtcgtatgtgugttctgatgugaca

SEQ ID NO: 99220 - DNA, 24 bp, Artificial Sequence
  Synthetic
cttacggctuactgcaatgcatuc

SEQ ID NO: 99221 - DNA, 17 bp, Artificial Sequence
  Synthetic
gcccgugttgcagaucc

SEQ ID NO: 99222 - DNA, 20 bp, Artificial Sequence
  Synthetic
caacgagaugctgugcaaga

SEQ ID NO: 99223 - DNA, 20 bp, Artificial Sequence
  Synthetic
ttctcgaucacggcguacag

SEQ ID NO: 99224 - DNA, 23 bp, Artificial Sequence
  Synthetic
gcaagcgacagacacutcuaaaa

SEQ ID NO: 99225 - DNA, 21 bp, Artificial Sequence
  Synthetic
gggaaagcucatcgtagcugt

SEQ ID NO: 99226 - DNA, 27 bp, Artificial Sequence
  Synthetic
actgccaatttuaaggagctgaatuct

SEQ ID NO: 99227 - DNA, 28 bp, Artificial Sequence
  Synthetic
agttctctgatgcutatctgactccuaa

SEQ ID NO: 99228 - DNA, 25 bp, Artificial Sequence
  Synthetic
ccuttgttatctacucaagccagga

SEQ ID NO: 99229 - DNA, 25 bp, Artificial Sequence
  Synthetic
ctttcggcttutatggaaacctuca

SEQ ID NO: 99230 - DNA, 26 bp, Artificial Sequence
  Synthetic
ttttaaccactucaagactgcuccat

SEQ ID NO: 99231 - DNA, 26 bp, Artificial Sequence
  Synthetic
catatagguatcagaauggcaaagca

SEQ ID NO: 99232 - DNA, 24 bp, Artificial Sequence
  Synthetic
tttttgcatuccaggttgctgtut

SEQ ID NO: 99233 - DNA, 25 bp, Artificial Sequence
  Synthetic
tcaagttucggacaacgacttuagt

SEQ ID NO: 99234 - DNA, 22 bp, Artificial Sequence
  Synthetic
gaaccctgugtgatcatgguct

SEQ ID NO: 99235 - DNA, 28 bp, Artificial Sequence
  Synthetic
cagaaagtatcugccacttagtagcaut

SEQ ID NO: 99236 - DNA, 18 bp, Artificial Sequence
  Synthetic
tggcccguctctgcttug

SEQ ID NO: 99237 - DNA, 19 bp, Artificial Sequence
  Synthetic
cgggaggagaguggugagt

SEQ ID NO: 99238 - DNA, 28 bp, Artificial Sequence
  Synthetic
aggctcaguagaacagaaaaaguacaag

SEQ ID NO: 99239 - DNA, 25 bp, Artificial Sequence
  Synthetic
acaaaggttcaaaguccttgagcua

SEQ ID NO: 99240 - DNA, 25 bp, Artificial Sequence
  Synthetic
tcctaccuggcagttttcaaaauga

SEQ ID NO: 99241 - DNA, 25 bp, Artificial Sequence
  Synthetic
tggauggactggcuaaaacaaacat

SEQ ID NO: 99242 - DNA, 29 bp, Artificial Sequence
  Synthetic
gttatttcttacccauctgactgtgtuct

SEQ ID NO: 99243 - DNA, 25 bp, Artificial Sequence
  Synthetic
acagttuggaacaacagcagagaua

SEQ ID NO: 99244 - DNA, 28 bp, Artificial Sequence
  Synthetic
caaaatcctgttcutctcgataggcaua

SEQ ID NO: 99245 - DNA, 29 bp, Artificial Sequence
  Synthetic
ctgtatttattgcuttgcctacttugcat

SEQ ID NO: 99246 - DNA, 19 bp, Artificial Sequence
  Synthetic
cagtgcugattcgcucagg

SEQ ID NO: 99247 - DNA, 27 bp, Artificial Sequence
  Synthetic
cctctcttcttcuttctgctccttcua

SEQ ID NO: 99248 - DNA, 22 bp, Artificial Sequence
  Synthetic
gatggttcaugctctgguggat

SEQ ID NO: 99249 - DNA, 28 bp, Artificial Sequence
  Synthetic
gtgtttaggtcugcatgaatttgatucc

SEQ ID NO: 99250 - DNA, 30 bp, Artificial Sequence
  Synthetic
ggaaaatacucacagcaaatgacattuagg

SEQ ID NO: 99251 - DNA, 26 bp, Artificial Sequence
  Synthetic
caccactaugtgccatttugaaacaa

SEQ ID NO: 99252 - DNA, 28 bp, Artificial Sequence
  Synthetic
ttcaggatcctucaaggaatcaaatuca

SEQ ID NO: 99253 - DNA, 25 bp, Artificial Sequence
  Synthetic
ccaagcauccaacatccaagtuagt

SEQ ID NO: 99254 - DNA, 21 bp, Artificial Sequence
  Synthetic
cggaugcggtattgtugagga

SEQ ID NO: 99255 - DNA, 23 bp, Artificial Sequence
  Synthetic
atttggtucaggaggatgcaugt

SEQ ID NO: 99256 - DNA, 25 bp, Artificial Sequence
  Synthetic
gccacttgaauaaaacaggcagcua

SEQ ID NO: 99257 - DNA, 23 bp, Artificial Sequence
  Synthetic
ggcatgggaauctcttcaucact

SEQ ID NO: 99258 - DNA, 20 bp, Artificial Sequence
  Synthetic
ccctcacugggagtcacugt

SEQ ID NO: 99259 - DNA, 20 bp, Artificial Sequence
  Synthetic
tgtuccccagagcagcatug

SEQ ID NO: 99260 - DNA, 27 bp, Artificial Sequence
  Synthetic
attattccggtuccacagctatuagac

SEQ ID NO: 99261 - DNA, 28 bp, Artificial Sequence
  Synthetic
gtttgtggttgtutgcatgtatactgua

SEQ ID NO: 99262 - DNA, 25 bp, Artificial Sequence
  Synthetic
cattggacugtattttugcccaaga

SEQ ID NO: 99263 - DNA, 24 bp, Artificial Sequence
  Synthetic
agtgtuacgacccagauacagaca

SEQ ID NO: 99264 - DNA, 27 bp, Artificial Sequence
  Synthetic
gtgaaatagcacutcatgttggucaat

SEQ ID NO: 99265 - DNA, 28 bp, Artificial Sequence
  Synthetic
gcttctggatucgagatgtaattttguc

SEQ ID NO: 99266 - DNA, 21 bp, Artificial Sequence
  Synthetic
cgccaagaacgagucatgtut

SEQ ID NO: 99267 - DNA, 26 bp, Artificial Sequence
  Synthetic
ccagggauaagagacaaauggaaaga

SEQ ID NO: 99268 - DNA, 21 bp, Artificial Sequence
  Synthetic
cattgcugccaacatcaucca

SEQ ID NO: 99269 - DNA, 21 bp, Artificial Sequence
  Synthetic
cuccaccttcugcaggacaat

SEQ ID NO: 99270 - DNA, 18 bp, Artificial Sequence
  Synthetic
gcaccgcguacaggugaa

SEQ ID NO: 99271 - DNA, 22 bp, Artificial Sequence
  Synthetic
aggaagctcutaatgccgucag

SEQ ID NO: 99272 - DNA, 30 bp, Artificial Sequence
  Synthetic
accatggatgugaagtcattcuaagaaaaa

SEQ ID NO: 99273 - DNA, 25 bp, Artificial Sequence
  Synthetic
ggagaagaacagutgctgagatcug

SEQ ID NO: 99274 - DNA, 19 bp, Artificial Sequence
  Synthetic
gacguggatcagugggaca

SEQ ID NO: 99275 - DNA, 17 bp, Artificial Sequence
  Synthetic
cccucccacccgcuaca

SEQ ID NO: 99276 - DNA, 23 bp, Artificial Sequence
  Synthetic
ttgctccugatggaattugggat

SEQ ID NO: 99277 - DNA, 26 bp, Artificial Sequence
  Synthetic
ttccaacagcuatcaucaacaacaga

SEQ ID NO: 99278 - DNA, 22 bp, Artificial Sequence
  Synthetic
cagucaacaucagcgcaaagag

SEQ ID NO: 99279 - DNA, 24 bp, Artificial Sequence
  Synthetic
tctaacactgugctcatgtggtut

SEQ ID NO: 99280 - DNA, 21 bp, Artificial Sequence
  Synthetic
actcugagagccccaaaccua

SEQ ID NO: 99281 - DNA, 23 bp, Artificial Sequence
  Synthetic
tgtactccuccccttcttuccag

SEQ ID NO: 99282 - DNA, 27 bp, Artificial Sequence
  Synthetic
aggcuaactaaaacatucggaaacaca

SEQ ID NO: 99283 - DNA, 20 bp, Artificial Sequence
  Synthetic
cccaactccautggcaaguc

SEQ ID NO: 99284 - DNA, 27 bp, Artificial Sequence
  Synthetic
gcatgttucaggaagaaaatucaggat

SEQ ID NO: 99285 - DNA, 28 bp, Artificial Sequence
  Synthetic
aagcgctuagaatcaaaattgtugaaaa

SEQ ID NO: 99286 - DNA, 22 bp, Artificial Sequence
  Synthetic
caaacctgtugctttgccugat

SEQ ID NO: 99287 - DNA, 28 bp, Artificial Sequence
  Synthetic
cagccattagtcauaaatgtttctgcut

SEQ ID NO: 99288 - DNA, 22 bp, Artificial Sequence
  Synthetic
gutggtgttuccagggaggaat

SEQ ID NO: 99289 - DNA, 18 bp, Artificial Sequence
  Synthetic
gcccaucaccucgaccac

SEQ ID NO: 99290 - DNA, 20 bp, Artificial Sequence
  Synthetic
cgatgtcautcgggucacct

SEQ ID NO: 99291 - DNA, 23 bp, Artificial Sequence
  Synthetic
tcacagctgcauctctctcttuc

SEQ ID NO: 99292 - DNA, 23 bp, Artificial Sequence
  Synthetic
cgcauaggaaaagccuaggaaag

SEQ ID NO: 99293 - DNA, 21 bp, Artificial Sequence
  Synthetic
tgtttttcccutcccgucaca

SEQ ID NO: 99294 - DNA, 29 bp, Artificial Sequence
  Synthetic
cgaacaatuaacatgaatgtttugcaagg

SEQ ID NO: 99295 - DNA, 28 bp, Artificial Sequence
  Synthetic
agtcaagaatcutcaaagtgcaaucaga

SEQ ID NO: 99296 - DNA, 28 bp, Artificial Sequence
  Synthetic
tctgattgcacuttgaagattctugact

SEQ ID NO: 99297 - DNA, 21 bp, Artificial Sequence
  Synthetic
gtgtgcugaccgttttcctug

SEQ ID NO: 99298 - DNA, 21 bp, Artificial Sequence
  Synthetic
accaggaugccatccacuaca

SEQ ID NO: 99299 - DNA, 19 bp, Artificial Sequence
  Synthetic
tgccacauccgcctcaaut

SEQ ID NO: 99300 - DNA, 20 bp, Artificial Sequence
  Synthetic
gtcatcctuggcatgggcua

SEQ ID NO: 99301 - DNA, 28 bp, Artificial Sequence
  Synthetic
acacatttaacucaacgtacttctgcut

SEQ ID NO: 99302 - DNA, 19 bp, Artificial Sequence
  Synthetic
gcttccucaggctugcagt

SEQ ID NO: 99303 - DNA, 24 bp, Artificial Sequence
  Synthetic
agagtctccaaggutcagttcuca

SEQ ID NO: 99304 - DNA, 25 bp, Artificial Sequence
  Synthetic
cagtuactgaaacacugacacagga

SEQ ID NO: 99305 - DNA, 20 bp, Artificial Sequence
  Synthetic
gcctgugacagcaagtucca

SEQ ID NO: 99306 - DNA, 23 bp, Artificial Sequence
  Synthetic
acatgcccaucataatgcauggt

SEQ ID NO: 99307 - DNA, 21 bp, Artificial Sequence
  Synthetic
gatctcguggacctccugaag

SEQ ID NO: 99308 - DNA, 24 bp, Artificial Sequence
  Synthetic
acaaggtcaaaugcttctgttgug

SEQ ID NO: 99309 - DNA, 25 bp, Artificial Sequence
  Synthetic
ttggagacguattcttagaggugga

SEQ ID NO: 99310 - DNA, 22 bp, Artificial Sequence
  Synthetic
tctggttucagctagtcuggga

SEQ ID NO: 99311 - DNA, 27 bp, Artificial Sequence
  Synthetic
actgctctagaautaagagggttugga

SEQ ID NO: 99312 - DNA, 23 bp, Artificial Sequence
  Synthetic
agtggttctuactccagccttuc

SEQ ID NO: 99313 - DNA, 25 bp, Artificial Sequence
  Synthetic
cttgccaautctgatggugacaaaa

SEQ ID NO: 99314 - DNA, 24 bp, Artificial Sequence
  Synthetic
tgctttgggagacaugatgttuct

SEQ ID NO: 99315 - DNA, 28 bp, Artificial Sequence
  Synthetic
gctcttccttucctgtgttcttcttuaa

SEQ ID NO: 99316 - DNA, 24 bp, Artificial Sequence
  Synthetic
ccaaagccccucaaaagaaggaut

SEQ ID NO: 99317 - DNA, 21 bp, Artificial Sequence
  Synthetic
gcccatugagagcctgaugac

SEQ ID NO: 99318 - DNA, 20 bp, Artificial Sequence
  Synthetic
ggtggtcaugagcagacgua

SEQ ID NO: 99319 - DNA, 18 bp, Artificial Sequence
  Synthetic
cccugcagagccuggaag

SEQ ID NO: 99320 - DNA, 28 bp, Artificial Sequence
  Synthetic
cttacctaccataugtggccattaacut

SEQ ID NO: 99321 - DNA, 24 bp, Artificial Sequence
  Synthetic
acatagcatcaucctttggtuccc

SEQ ID NO: 99322 - DNA, 19 bp, Artificial Sequence
  Synthetic
gcuccacggagccgatcua

SEQ ID NO: 99323 - DNA, 20 bp, Artificial Sequence
  Synthetic
aagucggtgcugaggaagac

SEQ ID NO: 99324 - DNA, 25 bp, Artificial Sequence
  Synthetic
ggaaggaucttuagaccaacaacga

SEQ ID NO: 99325 - DNA, 28 bp, Artificial Sequence
  Synthetic
ggaaatacguacaaagagtttgcaucat

SEQ ID NO: 99326 - DNA, 18 bp, Artificial Sequence
  Synthetic
gctgccacguccacucac

SEQ ID NO: 99327 - DNA, 21 bp, Artificial Sequence
  Synthetic
ggcuggccagagaagactuac

SEQ ID NO: 99328 - DNA, 27 bp, Artificial Sequence
  Synthetic
gccttggcattuagacatctttgaaut

SEQ ID NO: 99329 - DNA, 29 bp, Artificial Sequence
  Synthetic
tgctattaccaacaaguacctatctcuca

SEQ ID NO: 99330 - DNA, 20 bp, Artificial Sequence
  Synthetic
gctgaagugccactgtccuc

SEQ ID NO: 99331 - DNA, 20 bp, Artificial Sequence
  Synthetic
tgucccatguaccccaacct

SEQ ID NO: 99332 - DNA, 20 bp, Artificial Sequence
  Synthetic
ctggccaucagggtuaccat

SEQ ID NO: 99333 - DNA, 18 bp, Artificial Sequence
  Synthetic
cacagugccagaggcuga

SEQ ID NO: 99334 - DNA, 19 bp, Artificial Sequence
  Synthetic
ccagcatgucgctcagcut

SEQ ID NO: 99335 - DNA, 17 bp, Artificial Sequence
  Synthetic
cgggccuacaucacggt

SEQ ID NO: 99336 - DNA, 19 bp, Artificial Sequence
  Synthetic
cttcagccuctggcacugt

SEQ ID NO: 99337 - DNA, 18 bp, Artificial Sequence
  Synthetic
cgacctctuccgggccua

SEQ ID NO: 99338 - DNA, 24 bp, Artificial Sequence
  Synthetic
agactaguccctgtttcugaagga

SEQ ID NO: 99339 - DNA, 20 bp, Artificial Sequence
  Synthetic
aagactaugcccccucaggt

SEQ ID NO: 99340 - DNA, 22 bp, Artificial Sequence
  Synthetic
aaaacuggagggaggaccaauc

SEQ ID NO: 99341 - DNA, 21 bp, Artificial Sequence
  Synthetic
gcctcaactugcagctaggut

SEQ ID NO: 99342 - DNA, 21 bp, Artificial Sequence
  Synthetic
ctgtggugggaagctcaguaa

SEQ ID NO: 99343 - DNA, 28 bp, Artificial Sequence
  Synthetic
tcagatttgaaaugctaaaccucagagt

SEQ ID NO: 99344 - DNA, 22 bp, Artificial Sequence
  Synthetic
tcgcattcttucggttgccaua

SEQ ID NO: 99345 - DNA, 23 bp, Artificial Sequence
  Synthetic
cgacctatgaugcggagatgtug

SEQ ID NO: 99346 - DNA, 24 bp, Artificial Sequence
  Synthetic
tttaggagagaucagagtggccut

SEQ ID NO: 99347 - DNA, 27 bp, Artificial Sequence
  Synthetic
gaactctttgttuattgctgccguaat

SEQ ID NO: 99348 - DNA, 23 bp, Artificial Sequence
  Synthetic
ccagaggtguctttgctgaaguc

SEQ ID NO: 99349 - DNA, 22 bp, Artificial Sequence
  Synthetic
gggtctguggactatgatggua

SEQ ID NO: 99350 - DNA, 28 bp, Artificial Sequence
  Synthetic
tcattctgttattgucaattcccctgut

SEQ ID NO: 99351 - DNA, 28 bp, Artificial Sequence
  Synthetic
gaacaaccaagcuaatatgccatttuct

SEQ ID NO: 99352 - DNA, 22 bp, Artificial Sequence
  Synthetic
agggagauggaaggaaaugggt

SEQ ID NO: 99353 - DNA, 23 bp, Artificial Sequence
  Synthetic
agucaacaaaacggacagucaga

SEQ ID NO: 99354 - DNA, 33 bp, Artificial Sequence
  Synthetic
tgaagtaatttcuaatttttctgtctcucgact

SEQ ID NO: 99355 - DNA, 25 bp, Artificial Sequence
  Synthetic
gctaaagtguccagcagcaatcuaa

SEQ ID NO: 99356 - DNA, 25 bp, Artificial Sequence
  Synthetic
ccattccttacuccaaatgtgguca

SEQ ID NO: 99357 - DNA, 22 bp, Artificial Sequence
  Synthetic
agtcttgcuggcctttcttcut

SEQ ID NO: 99358 - DNA, 27 bp, Artificial Sequence
  Synthetic
agttgagccuagtaattgcatcatuga

SEQ ID NO: 99359 - DNA, 24 bp, Artificial Sequence
  Synthetic
tttctctttggucgaacaatugcc

SEQ ID NO: 99360 - DNA, 28 bp, Artificial Sequence
  Synthetic
aaaattcacaccuaccacaggtuaaaga

SEQ ID NO: 99361 - DNA, 24 bp, Artificial Sequence
  Synthetic
ggaagcattaucttgaccagcuga

SEQ ID NO: 99362 - DNA, 28 bp, Artificial Sequence
  Synthetic
tctaaacaacagtauaatgcctgcctut

SEQ ID NO: 99363 - DNA, 22 bp, Artificial Sequence
  Synthetic
catggaccccugatgatuccac

SEQ ID NO: 99364 - DNA, 22 bp, Artificial Sequence
  Synthetic
ggatccgaugctctagcagtut

SEQ ID NO: 99365 - DNA, 22 bp, Artificial Sequence
  Synthetic
ccgagctuctatctgggauacc

SEQ ID NO: 99366 - DNA, 21 bp, Artificial Sequence
  Synthetic
ggtgugcaagggtatucggaa

SEQ ID NO: 99367 - DNA, 22 bp, Artificial Sequence
  Synthetic
acacuccgaaucaaagccacaa

SEQ ID NO: 99368 - DNA, 25 bp, Artificial Sequence
  Synthetic
gtaugaagaaacagactggucacct

SEQ ID NO: 99369 - DNA, 26 bp, Artificial Sequence
  Synthetic
tgtttctcctgugacttcttcctgua

SEQ ID NO: 99370 - DNA, 22 bp, Artificial Sequence
  Synthetic
acctgtgutcattcacaugagg

SEQ ID NO: 99371 - DNA, 20 bp, Artificial Sequence
  Synthetic
agagcttgtuctggccgtut

SEQ ID NO: 99372 - DNA, 23 bp, Artificial Sequence
  Synthetic
gggaacctuacccaaaatguggt

SEQ ID NO: 99373 - DNA, 28 bp, Artificial Sequence
  Synthetic
ctgtaacaccagauaccattttcaguct

SEQ ID NO: 99374 - DNA, 18 bp, Artificial Sequence
  Synthetic
accccuttcugggaggca

SEQ ID NO: 99375 - DNA, 21 bp, Artificial Sequence
  Synthetic
ggctcccugtctggagacuat

SEQ ID NO: 99376 - DNA, 24 bp, Artificial Sequence
  Synthetic
gagacacaaucacugacaaaacgg

SEQ ID NO: 99377 - DNA, 21 bp, Artificial Sequence
  Synthetic
ccttccccuttcacactcuca

SEQ ID NO: 99378 - DNA, 17 bp, Artificial Sequence
  Synthetic
gcgcccucaccgtgaug

SEQ ID NO: 99379 - DNA, 17 bp, Artificial Sequence
  Synthetic
gcgccguggttgttcug

SEQ ID NO: 99380 - DNA, 19 bp, Artificial Sequence
  Synthetic
ttgccgtuctctgccguat

SEQ ID NO: 99381 - DNA, 21 bp, Artificial Sequence
  Synthetic
atggctguctctgaaaugcca

SEQ ID NO: 99382 - DNA, 26 bp, Artificial Sequence
  Synthetic
aacatgttttugggtatttctggugt

SEQ ID NO: 99383 - DNA, 20 bp, Artificial Sequence
  Synthetic
gaccucaagcctuccaacct

SEQ ID NO: 99384 - DNA, 22 bp, Artificial Sequence
  Synthetic
gtagtucagaggagtuggcagt

SEQ ID NO: 99385 - DNA, 23 bp, Artificial Sequence
  Synthetic
gccctgttuctgattctgtucca

SEQ ID NO: 99386 - DNA, 23 bp, Artificial Sequence
  Synthetic
ttgagaucacaggtggtgtugag

SEQ ID NO: 99387 - DNA, 28 bp, Artificial Sequence
  Synthetic
tcatggaaacagauctttacaagctcut

SEQ ID NO: 99388 - DNA, 19 bp, Artificial Sequence
  Synthetic
tgcaccaccuaccuccaga

SEQ ID NO: 99389 - DNA, 21 bp, Artificial Sequence
  Synthetic
catcaccugccccttgtagut

SEQ ID NO: 99390 - DNA, 28 bp, Artificial Sequence
  Synthetic
tgatttgtgugaaaattcactgcaucat

SEQ ID NO: 99391 - DNA, 28 bp, Artificial Sequence
  Synthetic
cgctgaactgttuatgtctccagtaaua

SEQ ID NO: 99392 - DNA, 29 bp, Artificial Sequence
  Synthetic
ttctgtgtttaauctgctgtcttaaugga

SEQ ID NO: 99393 - DNA, 27 bp, Artificial Sequence
  Synthetic
catcacaacagagacautcaacaacut

SEQ ID NO: 99394 - DNA, 20 bp, Artificial Sequence
  Synthetic
cctgccuggcattucagaga

SEQ ID NO: 99395 - DNA, 18 bp, Artificial Sequence
  Synthetic
caccatcaccugccccut

SEQ ID NO: 99396 - DNA, 21 bp, Artificial Sequence
  Synthetic
cggcatucccaccaacuacaa

SEQ ID NO: 99397 - DNA, 33 bp, Artificial Sequence
  Synthetic
tagaaaacaauacagtactttctugaaggaaac

SEQ ID NO: 99398 - DNA, 23 bp, Artificial Sequence
  Synthetic
cgaaagcagucagagtcttccut

SEQ ID NO: 99399 - DNA, 28 bp, Artificial Sequence
  Synthetic
aggttcagaagtugcaaataaagcaaug

SEQ ID NO: 99400 - DNA, 22 bp, Artificial Sequence
  Synthetic
gcaagcccacagaugagaaucc

SEQ ID NO: 99401 - DNA, 22 bp, Artificial Sequence
  Synthetic
cacccttugccatctgtctuga

SEQ ID NO: 99402 - DNA, 23 bp, Artificial Sequence
  Synthetic
cattgctgaggugttgtgtctuc

SEQ ID NO: 99403 - DNA, 27 bp, Artificial Sequence
  Synthetic
ttttcaatgcuttgctaaatgugacca

SEQ ID NO: 99404 - DNA, 19 bp, Artificial Sequence
  Synthetic
accccttucaggacccugt

SEQ ID NO: 99405 - DNA, 20 bp, Artificial Sequence
  Synthetic
cttcccugcgtcctttcuct

SEQ ID NO: 99406 - DNA, 21 bp, Artificial Sequence
  Synthetic
cctgaagagcuctcaggctua

SEQ ID NO: 99407 - DNA, 25 bp, Artificial Sequence
  Synthetic
tttgcaacccagaaugactttgtuc

SEQ ID NO: 99408 - DNA, 27 bp, Artificial Sequence
  Synthetic
attattatcgctguctctgaggaguct

SEQ ID NO: 99409 - DNA, 28 bp, Artificial Sequence
  Synthetic
gcgtccaguaataatcttuagacccaaa

SEQ ID NO: 99410 - DNA, 23 bp, Artificial Sequence
  Synthetic
ccaguacccagagaccaagauca

SEQ ID NO: 99411 - DNA, 26 bp, Artificial Sequence
  Synthetic
cagtgaaccguaatttcucaaaagca

SEQ ID NO: 99412 - DNA, 26 bp, Artificial Sequence
  Synthetic
cattaacaccautatgttugcagcca

SEQ ID NO: 99413 - DNA, 25 bp, Artificial Sequence
  Synthetic
gctucagaaggatcauaccagacat

SEQ ID NO: 99414 - DNA, 20 bp, Artificial Sequence
  Synthetic
agcctgtugcaatggtccuc

SEQ ID NO: 99415 - DNA, 28 bp, Artificial Sequence
  Synthetic
gctaacatgaatccutgtctccttacuc

SEQ ID NO: 99416 - DNA, 28 bp, Artificial Sequence
  Synthetic
ttgttccttgtauaagaaatggtgcuga

SEQ ID NO: 99417 - DNA, 26 bp, Artificial Sequence
  Synthetic
acaggagguacactcagtgaaattug

SEQ ID NO: 99418 - DNA, 26 bp, Artificial Sequence
  Synthetic
gccagatcucacaggaattacacuat

SEQ ID NO: 99419 - DNA, 30 bp, Artificial Sequence
  Synthetic
cctcacacgttatutaataggactgtacut

SEQ ID NO: 99420 - DNA, 21 bp, Artificial Sequence
  Synthetic
ctcuccaacacccgtacauca

SEQ ID NO: 99421 - DNA, 28 bp, Artificial Sequence
  Synthetic
ctcctccaaaccuaactgtcattcuaac

SEQ ID NO: 99422 - DNA, 27 bp, Artificial Sequence
  Synthetic
gagattggagaautccctgtgttttuc

SEQ ID NO: 99423 - DNA, 28 bp, Artificial Sequence
  Synthetic
gtctcactcuctatctgaatatcuccgt

SEQ ID NO: 99424 - DNA, 20 bp, Artificial Sequence
  Synthetic
tcaccccuactcccaacuga

SEQ ID NO: 99425 - DNA, 21 bp, Artificial Sequence
  Synthetic
gtcactttcuccctccaucca

SEQ ID NO: 99426 - DNA, 28 bp, Artificial Sequence
  Synthetic
cagtgtcgtatugttgatctgatauggt

SEQ ID NO: 99427 - DNA, 27 bp, Artificial Sequence
  Synthetic
tcaatcctaauaggcagagaagagcua

SEQ ID NO: 99428 - DNA, 24 bp, Artificial Sequence
  Synthetic
tggcataguggaacatgtgatuga

SEQ ID NO: 99429 - DNA, 27 bp, Artificial Sequence
  Synthetic
gcttgguaacacatgctgtatuaaacc

SEQ ID NO: 99430 - DNA, 23 bp, Artificial Sequence
  Synthetic
caggtcaugggttataggugcaa

SEQ ID NO: 99431 - DNA, 28 bp, Artificial Sequence
  Synthetic
ccctgtagagaautgaaaatggugaaga

SEQ ID NO: 99432 - DNA, 21 bp, Artificial Sequence
  Synthetic
gcctttcugaggcagggttua

SEQ ID NO: 99433 - DNA, 20 bp, Artificial Sequence
  Synthetic
cagguagaaagugcgaggct

SEQ ID NO: 99434 - DNA, 22 bp, Artificial Sequence
  Synthetic
agcacagtcaucatggcctauc

SEQ ID NO: 99435 - DNA, 28 bp, Artificial Sequence
  Synthetic
gctttgctatcaugaaatgtatgccaut

SEQ ID NO: 99436 - DNA, 24 bp, Artificial Sequence
  Synthetic
agcagagaaccuaccagaaacuca

SEQ ID NO: 99437 - DNA, 19 bp, Artificial Sequence
  Synthetic
acaccaagggacgaugugg

SEQ ID NO: 99438 - DNA, 28 bp, Artificial Sequence
  Synthetic
gcgaatatcttgacucctttaaggtgut

SEQ ID NO: 99439 - DNA, 23 bp, Artificial Sequence
  Synthetic
cctttccaaacutgaggctcugt

SEQ ID NO: 99440 - DNA, 22 bp, Artificial Sequence
  Synthetic
acccctuccaggagttttcuct

SEQ ID NO: 99441 - DNA, 24 bp, Artificial Sequence
  Synthetic
cagtcutttatcagcuggacagga

SEQ ID NO: 99442 - DNA, 23 bp, Artificial Sequence
  Synthetic
ggaaaaagucaggaucccagcaa

SEQ ID NO: 99443 - DNA, 20 bp, Artificial Sequence
  Synthetic
ccucccgaacacacactcuc

SEQ ID NO: 99444 - DNA, 25 bp, Artificial Sequence
  Synthetic
gaagatttaucagcgtgcattuggt

SEQ ID NO: 99445 - DNA, 21 bp, Artificial Sequence
  Synthetic
gcggcctuacccttccataua

SEQ ID NO: 99446 - DNA, 20 bp, Artificial Sequence
  Synthetic
ctgatucggccagagctcut

SEQ ID NO: 99447 - DNA, 24 bp, Artificial Sequence
  Synthetic
tcctcttttcutatcctccugcca

SEQ ID NO: 99448 - DNA, 17 bp, Artificial Sequence
  Synthetic
gaagggcgcaggcugua

SEQ ID NO: 99449 - DNA, 18 bp, Artificial Sequence
  Synthetic
cccacaccuccagccuct

SEQ ID NO: 99450 - DNA, 20 bp, Artificial Sequence
  Synthetic
ggactggccacucgctatug

SEQ ID NO: 99451 - DNA, 20 bp, Artificial Sequence
  Synthetic
ccacgctgcugttctctgut

SEQ ID NO: 99452 - DNA, 24 bp, Artificial Sequence
  Synthetic
gggttcacuagagacctctgucat

SEQ ID NO: 99453 - DNA, 23 bp, Artificial Sequence
  Synthetic
cacaaaagcacuttccuccacag

SEQ ID NO: 99454 - DNA, 26 bp, Artificial Sequence
  Synthetic
gcatgattguacatctctctctugga

SEQ ID NO: 99455 - DNA, 28 bp, Artificial Sequence
  Synthetic
aauattttgctagatucacagggacaca

SEQ ID NO: 99456 - DNA, 24 bp, Artificial Sequence
  Synthetic
agaguccgaagtcaguaaggacaa

SEQ ID NO: 99457 - DNA, 28 bp, Artificial Sequence
  Synthetic
cagtgaaccuaaaatgcctctaauacct

SEQ ID NO: 99458 - DNA, 25 bp, Artificial Sequence
  Synthetic
cagaaagtttgaautcccagccauc

SEQ ID NO: 99459 - DNA, 25 bp, Artificial Sequence
  Synthetic
ggtgtaatgatucacaatggctugt

SEQ ID NO: 99460 - DNA, 22 bp, Artificial Sequence
  Synthetic
gcagtccacaaaagaugggcua

SEQ ID NO: 99461 - DNA, 20 bp, Artificial Sequence
  Synthetic
gagcgcuacgatguggaaac

SEQ ID NO: 99462 - DNA, 21 bp, Artificial Sequence
  Synthetic
gctacgaaaguccacgtcuct

SEQ ID NO: 99463 - DNA, 22 bp, Artificial Sequence
  Synthetic
cttctctgcauggtgcccttua

SEQ ID NO: 99464 - DNA, 21 bp, Artificial Sequence
  Synthetic
cggccaccaugttgcttcaua

SEQ ID NO: 99465 - DNA, 27 bp, Artificial Sequence
  Synthetic
accttctgaauaacaaaggccactuac

SEQ ID NO: 99466 - DNA, 22 bp, Artificial Sequence
  Synthetic
ccctcccaccugatgtgttcua

SEQ ID NO: 99467 - DNA, 25 bp, Artificial Sequence
  Synthetic
gtttgacatugacattcggcuacag

SEQ ID NO: 99468 - DNA, 20 bp, Artificial Sequence
  Synthetic
cagccccuggattcgtacuc

SEQ ID NO: 99469 - DNA, 23 bp, Artificial Sequence
  Synthetic
atgacctcucctgtggttttucc

SEQ ID NO: 99470 - DNA, 28 bp, Artificial Sequence
  Synthetic
atgaatcatgtgccuaggaaaagtagut

SEQ ID NO: 99471 - DNA, 22 bp, Artificial Sequence
  Synthetic
ctgacatgcutgcagcttctuc

SEQ ID NO: 99472 - DNA, 20 bp, Artificial Sequence
  Synthetic
ccccgcauctccttgtccua

SEQ ID NO: 99473 - DNA, 20 bp, Artificial Sequence
  Synthetic
ccttcccuttcaggcuccag

SEQ ID NO: 99474 - DNA, 22 bp, Artificial Sequence
  Synthetic
ggaaaugggcattgtucaagca

SEQ ID NO: 99475 - DNA, 24 bp, Artificial Sequence
  Synthetic
ctcctgaggautctgccatttcuc

SEQ ID NO: 99476 - DNA, 22 bp, Artificial Sequence
  Synthetic
catcctcacuccccagatcuca

SEQ ID NO: 99477 - DNA, 28 bp, Artificial Sequence
  Synthetic
ggactgagtagugtatatgtttgugcag

SEQ ID NO: 99478 - DNA, 21 bp, Artificial Sequence
  Synthetic
cacaacctuctgctccaucag

SEQ ID NO: 99479 - DNA, 22 bp, Artificial Sequence
  Synthetic
cccaggaugctaatggtctugt

SEQ ID NO: 99480 - DNA, 26 bp, Artificial Sequence
  Synthetic
cgcaacttauggctttttcattgugt

SEQ ID NO: 99481 - DNA, 22 bp, Artificial Sequence
  Synthetic
ggatggtgtuacggtcactcug

SEQ ID NO: 99482 - DNA, 22 bp, Artificial Sequence
  Synthetic
gcaauattguagggagcaggca

SEQ ID NO: 99483 - DNA, 24 bp, Artificial Sequence
  Synthetic
ctgtttcccuggtctgttttucag

SEQ ID NO: 99484 - DNA, 21 bp, Artificial Sequence
  Synthetic
gcattgcugcagagtcttugg

SEQ ID NO: 99485 - DNA, 22 bp, Artificial Sequence
  Synthetic
tctgcagagcuacacagttugg

SEQ ID NO: 99486 - DNA, 28 bp, Artificial Sequence
  Synthetic
caaagaaggaacagguatacttucaggt

SEQ ID NO: 99487 - DNA, 24 bp, Artificial Sequence
  Synthetic
ccctggtugataaaacatcgugga

SEQ ID NO: 99488 - DNA, 28 bp, Artificial Sequence
  Synthetic
aaagcgaacacaugtaattttccttugt

SEQ ID NO: 99489 - DNA, 25 bp, Artificial Sequence
  Synthetic
tggacagcgaagcuctataggauag

SEQ ID NO: 99490 - DNA, 19 bp, Artificial Sequence
  Synthetic
gagctcccucctgtccuga

SEQ ID NO: 99491 - DNA, 19 bp, Artificial Sequence
  Synthetic
tcagctcgcaguccaggua

SEQ ID NO: 99492 - DNA, 25 bp, Artificial Sequence
  Synthetic
gaagagugcattcccaugaagagaa

SEQ ID NO: 99493 - DNA, 22 bp, Artificial Sequence
  Synthetic
tggagactguggtcttctucct

SEQ ID NO: 99494 - DNA, 22 bp, Artificial Sequence
  Synthetic
gaacuaucagaagccccaggaa

SEQ ID NO: 99495 - DNA, 22 bp, Artificial Sequence
  Synthetic
tcatggagguaccagtuacggt

SEQ ID NO: 99496 - DNA, 26 bp, Artificial Sequence
  Synthetic
acatcagagutactttcuggcaagac

SEQ ID NO: 99497 - DNA, 28 bp, Artificial Sequence
  Synthetic
agccttcauaccaaacttcaatcaauga

SEQ ID NO: 99498 - DNA, 20 bp, Artificial Sequence
  Synthetic
tuccaaggccaagaagcugt

SEQ ID NO: 99499 - DNA, 21 bp, Artificial Sequence
  Synthetic
tgctgtgugccactctctaug

SEQ ID NO: 99500 - DNA, 21 bp, Artificial Sequence
  Synthetic
gcaggtgcucaagtacgaguc

SEQ ID NO: 99501 - DNA, 20 bp, Artificial Sequence
  Synthetic
ggcugggatucccacagaac

SEQ ID NO: 99502 - DNA, 26 bp, Artificial Sequence
  Synthetic
ctggccttcugttcccaatatuaaga

SEQ ID NO: 99503 - DNA, 25 bp, Artificial Sequence
  Synthetic
gatcaaccaagccaaautccucaac

SEQ ID NO: 99504 - DNA, 24 bp, Artificial Sequence
  Synthetic
ccgagauaaaaccctgaggtcuct

SEQ ID NO: 99505 - DNA, 22 bp, Artificial Sequence
  Synthetic
tgtcgatcuctctgttguccga

SEQ ID NO: 99506 - DNA, 28 bp, Artificial Sequence
  Synthetic
ctgatttgcatcutcacattttgcttut

SEQ ID NO: 99507 - DNA, 26 bp, Artificial Sequence
  Synthetic
cttcactgguatcaatgtaggtugct

SEQ ID NO: 99508 - DNA, 21 bp, Artificial Sequence
  Synthetic
ctgcttatuggcctcugagga

SEQ ID NO: 99509 - DNA, 22 bp, Artificial Sequence
  Synthetic
gtggccccucctaatttgacut

SEQ ID NO: 99510 - DNA, 18 bp, Artificial Sequence
  Synthetic
ccgcatugccgagaucca

SEQ ID NO: 99511 - DNA, 20 bp, Artificial Sequence
  Synthetic
gaagtauggagccgccacut

SEQ ID NO: 99512 - DNA, 23 bp, Artificial Sequence
  Synthetic
tttaccugaagctgttccuggag

SEQ ID NO: 99513 - DNA, 26 bp, Artificial Sequence
  Synthetic
tttccctgagugtgaattttccucaa

SEQ ID NO: 99514 - DNA, 22 bp, Artificial Sequence
  Synthetic
cccagaagaggaguagggtcuc

SEQ ID NO: 99515 - DNA, 28 bp, Artificial Sequence
  Synthetic
gatgttcctcaaautctgaaacttgcua

SEQ ID NO: 99516 - DNA, 22 bp, Artificial Sequence
  Synthetic
cgcagagagcuatcctgugaga

SEQ ID NO: 99517 - DNA, 21 bp, Artificial Sequence
  Synthetic
gcatcuggcagataacaucgg

SEQ ID NO: 99518 - DNA, 24 bp, Artificial Sequence
  Synthetic
cttggtauggctgcttctauggat

SEQ ID NO: 99519 - DNA, 23 bp, Artificial Sequence
  Synthetic
tcttcaggugctttaggtcucca

SEQ ID NO: 99520 - DNA, 24 bp, Artificial Sequence
  Synthetic
tgaccctgcucagatggagaauat

SEQ ID NO: 99521 - DNA, 28 bp, Artificial Sequence
  Synthetic
acatgtaacacagautgatgtugaaggt

SEQ ID NO: 99522 - DNA, 27 bp, Artificial Sequence
  Synthetic
aatcccaccccautctttaactctuac

SEQ ID NO: 99523 - DNA, 25 bp, Artificial Sequence
  Synthetic
actgagtcgtcugctcttctctuaa

SEQ ID NO: 99524 - DNA, 24 bp, Artificial Sequence
  Synthetic
gcttcgtugtacttactuggcaga

SEQ ID NO: 99525 - DNA, 28 bp, Artificial Sequence
  Synthetic
cagcatcatcagugtaaacaaaaaguca

SEQ ID NO: 99526 - DNA, 22 bp, Artificial Sequence
  Synthetic
ctttttgtcauggccacaugct

SEQ ID NO: 99527 - DNA, 22 bp, Artificial Sequence
  Synthetic
tcacagtggagutccgcatuac

SEQ ID NO: 99528 - DNA, 27 bp, Artificial Sequence
  Synthetic
gttagagttgcautccatttggugaaa

SEQ ID NO: 99529 - DNA, 25 bp, Artificial Sequence
  Synthetic
gtcggacucaaacaaatgttcacuc

SEQ ID NO: 99530 - DNA, 28 bp, Artificial Sequence
  Synthetic
gtcctggacuactaaaaggagtauacca

SEQ ID NO: 99531 - DNA, 24 bp, Artificial Sequence
  Synthetic
actcagtcaggguatcagttcugt

SEQ ID NO: 99532 - DNA, 26 bp, Artificial Sequence
  Synthetic
tgtgtgtggcauatacaggtauaggt

SEQ ID NO: 99533 - DNA, 28 bp, Artificial Sequence
  Synthetic
gcatgtaatcacautggaggttatcugt

SEQ ID NO: 99534 - DNA, 27 bp, Artificial Sequence
  Synthetic
agatttattataugccctggacuccct

SEQ ID NO: 99535 - DNA, 22 bp, Artificial Sequence
  Synthetic
gtgcgcuctttgtugaagaaca

SEQ ID NO: 99536 - DNA, 27 bp, Artificial Sequence
  Synthetic
tttgtgcttaactuaccactgactcut

SEQ ID NO: 99537 - DNA, 25 bp, Artificial Sequence
  Synthetic
acaaaagcugattctgtcaucacca

SEQ ID NO: 99538 - DNA, 21 bp, Artificial Sequence
  Synthetic
cctcccaagcugaggctttut

SEQ ID NO: 99539 - DNA, 25 bp, Artificial Sequence
  Synthetic
ctatctgcgacutgaagagaaccut

SEQ ID NO: 99540 - DNA, 21 bp, Artificial Sequence
  Synthetic
tucaggtgctuaaggcgacaa

SEQ ID NO: 99541 - DNA, 28 bp, Artificial Sequence
  Synthetic
ccctcccatacagucaactatgaatgua

SEQ ID NO: 99542 - DNA, 21 bp, Artificial Sequence
  Synthetic
gcttgtgucccagctcugaac

SEQ ID NO: 99543 - DNA, 21 bp, Artificial Sequence
  Synthetic
atgcugaagaccactggucac

SEQ ID NO: 99544 - DNA, 24 bp, Artificial Sequence
  Synthetic
gctcaaggaaagccauttcatugt

SEQ ID NO: 99545 - DNA, 21 bp, Artificial Sequence
  Synthetic
ctgggcucagacgucaaagat

SEQ ID NO: 99546 - DNA, 22 bp, Artificial Sequence
  Synthetic
tcatccgccuccttcatctcua

SEQ ID NO: 99547 - DNA, 20 bp, Artificial Sequence
  Synthetic
ggatgcugccttctccucac

SEQ ID NO: 99548 - DNA, 19 bp, Artificial Sequence
  Synthetic
ccctcaccacacuccccut

SEQ ID NO: 99549 - DNA, 24 bp, Artificial Sequence
  Synthetic
cgggaagaaaugacagcaauacag

SEQ ID NO: 99550 - DNA, 27 bp, Artificial Sequence
  Synthetic
caggatttgtagugtatgatggagcut

SEQ ID NO: 99551 - DNA, 23 bp, Artificial Sequence
  Synthetic
ctatgtcagauttgccuccccat

SEQ ID NO: 99552 - DNA, 23 bp, Artificial Sequence
  Synthetic
cggccaaaaucaatguggaacat

SEQ ID NO: 99553 - DNA, 24 bp, Artificial Sequence
  Synthetic
ctttatgtcctcucctcccatcug

SEQ ID NO: 99554 - DNA, 24 bp, Artificial Sequence
  Synthetic
gtctaccucctggaaagauaccct

SEQ ID NO: 99555 - DNA, 18 bp, Artificial Sequence
  Synthetic
cacuggcgacagcuggaa

SEQ ID NO: 99556 - DNA, 18 bp, Artificial Sequence
  Synthetic
cccggtucttccagcugt

SEQ ID NO: 99557 - DNA, 22 bp, Artificial Sequence
  Synthetic
gcaagaacaugtcggagtucct

SEQ ID NO: 99558 - DNA, 18 bp, Artificial Sequence
  Synthetic
gctgucgccagtgtuggt

SEQ ID NO: 99559 - DNA, 19 bp, Artificial Sequence
  Synthetic
cctgaccacccutcccuga

SEQ ID NO: 99560 - DNA, 22 bp, Artificial Sequence
  Synthetic
ggagaacaaaguggcuggaact

SEQ ID NO: 99561 - DNA, 21 bp, Artificial Sequence
  Synthetic
gggcaaaauccaacagcauca

SEQ ID NO: 99562 - DNA, 28 bp, Artificial Sequence
  Synthetic
agaaggacaaaggaautcagaagatuca

SEQ ID NO: 99563 - DNA, 23 bp, Artificial Sequence
  Synthetic
cgatttcgctucttcagtggtut

SEQ ID NO: 99564 - DNA, 27 bp, Artificial Sequence
  Synthetic
ctgggtacauaagaaggtgaacagtut

SEQ ID NO: 99565 - DNA, 21 bp, Artificial Sequence
  Synthetic
tgccctcutgttcccaucaac

SEQ ID NO: 99566 - DNA, 22 bp, Artificial Sequence
  Synthetic
aacccgaggutttcactucact

SEQ ID NO: 99567 - DNA, 28 bp, Artificial Sequence
  Synthetic
caaactggtatagauccttacccccuaa

SEQ ID NO: 99568 - DNA, 17 bp, Artificial Sequence
  Synthetic
cugccgagggcucacaa

SEQ ID NO: 99569 - DNA, 17 bp, Artificial Sequence
  Synthetic
cggccccucagaccuac

SEQ ID NO: 99570 - DNA, 26 bp, Artificial Sequence
  Synthetic
caattaccatgauacctcccctuacc

SEQ ID NO: 99571 - DNA, 23 bp, Artificial Sequence
  Synthetic
gcagtaucccatgttcctucgat

SEQ ID NO: 99572 - DNA, 28 bp, Artificial Sequence
  Synthetic
atcacatttccatugtccttcaactcua

SEQ ID NO: 99573 - DNA, 23 bp, Artificial Sequence
  Synthetic
ctcgaaugaactgtggttuccag

SEQ ID NO: 99574 - DNA, 28 bp, Artificial Sequence
  Synthetic
cacaaatcugaccctacauacagaagaa

SEQ ID NO: 99575 - DNA, 21 bp, Artificial Sequence
  Synthetic
ggtgtttgcautgctcaguca

SEQ ID NO: 99576 - DNA, 22 bp, Artificial Sequence
  Synthetic
cctcaggcutactucaggcaaa

SEQ ID NO: 99577 - DNA, 20 bp, Artificial Sequence
  Synthetic
tgaatuccccacgguggaaa

SEQ ID NO: 99578 - DNA, 23 bp, Artificial Sequence
  Synthetic
agaggctgugagatggcatatuc

SEQ ID NO: 99579 - DNA, 20 bp, Artificial Sequence
  Synthetic
gaacucacagggccucagat

SEQ ID NO: 99580 - DNA, 25 bp, Artificial Sequence
  Synthetic
aaggtctttgcuggtgataatugga

SEQ ID NO: 99581 - DNA, 28 bp, Artificial Sequence
  Synthetic
ggctaaacaacagagautttcctccuaa

SEQ ID NO: 99582 - DNA, 28 bp, Artificial Sequence
  Synthetic
agcgtgaaatttuaagttgccaagaaut

SEQ ID NO: 99583 - DNA, 22 bp, Artificial Sequence
  Synthetic
ctggactgggcuatctcactuc

SEQ ID NO: 99584 - DNA, 21 bp, Artificial Sequence
  Synthetic
tutgggactcugacggcaaat

SEQ ID NO: 99585 - DNA, 25 bp, Artificial Sequence
  Synthetic
tcttgtgauggaatatgcugaaggg

SEQ ID NO: 99586 - DNA, 28 bp, Artificial Sequence
  Synthetic
gataaagacagguctaatgacacucacc

SEQ ID NO: 99587 - DNA, 22 bp, Artificial Sequence
  Synthetic
gccctaagaugatggagctuct

SEQ ID NO: 99588 - DNA, 28 bp, Artificial Sequence
  Synthetic
attggtcactttutgttttggttctuga

SEQ ID NO: 99589 - DNA, 25 bp, Artificial Sequence
  Synthetic
atctcgattacutggacttgtuggg

SEQ ID NO: 99590 - DNA, 25 bp, Artificial Sequence
  Synthetic
aacaaauacatuaggagcgaaggct

SEQ ID NO: 99591 - DNA, 28 bp, Artificial Sequence
  Synthetic
gaagaagcacucaaacagttuaagcaaa

SEQ ID NO: 99592 - DNA, 23 bp, Artificial Sequence
  Synthetic
ctcaccagauaggagguccagat

SEQ ID NO: 99593 - DNA, 23 bp, Artificial Sequence
  Synthetic
aacaaactcuaggtccuggcaag

SEQ ID NO: 99594 - DNA, 23 bp, Artificial Sequence
  Synthetic
ccaagtcctgutcctgactccua

SEQ ID NO: 99595 - DNA, 22 bp, Artificial Sequence
  Synthetic
gagggaggagcuaaacggtuac

SEQ ID NO: 99596 - DNA, 20 bp, Artificial Sequence
  Synthetic
gcguggatcaagugccagat

SEQ ID NO: 99597 - DNA, 25 bp, Artificial Sequence
  Synthetic
cattttcttuccccatcttcaccuc

SEQ ID NO: 99598 - DNA, 17 bp, Artificial Sequence
  Synthetic
ggcacggccaugaucac

SEQ ID NO: 99599 - DNA, 24 bp, Artificial Sequence
  Synthetic
caucacatgctuacaagacacaca

SEQ ID NO: 99600 - DNA, 20 bp, Artificial Sequence
  Synthetic
agccatgcugcacgacttua

SEQ ID NO: 99601 - DNA, 26 bp, Artificial Sequence
  Synthetic
gagaacacagaaaauauagccaccgt

SEQ ID NO: 99602 - DNA, 21 bp, Artificial Sequence
  Synthetic
ccctgagcgccucatcaaaut

SEQ ID NO: 99603 - DNA, 28 bp, Artificial Sequence
  Synthetic
gcagactttgauatttgcacatctcuac

SEQ ID NO: 99604 - DNA, 21 bp, Artificial Sequence
  Synthetic
ctgaatcugggctgagccaua

SEQ ID NO: 99605 - DNA, 21 bp, Artificial Sequence
  Synthetic
ccugcagtcatugcagaacca

SEQ ID NO: 99606 - DNA, 21 bp, Artificial Sequence
  Synthetic
ccggatcucagtgtctuggga

SEQ ID NO: 99607 - DNA, 17 bp, Artificial Sequence
  Synthetic
tgagcgugccccguaac

SEQ ID NO: 99608 - DNA, 22 bp, Artificial Sequence
  Synthetic
cctgaacaucgagatgccugac

SEQ ID NO: 99609 - DNA, 26 bp, Artificial Sequence
  Synthetic
aagtactguaaagcgaacacatguga

SEQ ID NO: 99610 - DNA, 24 bp, Artificial Sequence
  Synthetic
gugggaataaaaaugcgacacact

SEQ ID NO: 99611 - DNA, 22 bp, Artificial Sequence
  Synthetic
acctgagcagcucttcaatcuc

SEQ ID NO: 99612 - DNA, 33 bp, Artificial Sequence
  Synthetic
tgtgttactagauatgattgctattttuaaggg

SEQ ID NO: 99613 - DNA, 28 bp, Artificial Sequence
  Synthetic
tcccaaatagacuccatgattcguagaa

SEQ ID NO: 99614 - DNA, 19 bp, Artificial Sequence
  Synthetic
ctgugtttcgaugcccaga

SEQ ID NO: 99615 - DNA, 26 bp, Artificial Sequence
  Synthetic
ttttcaaacgagcugagaggtctaut

SEQ ID NO: 99616 - DNA, 22 bp, Artificial Sequence
  Synthetic
gcatagatguggccatcgauga

SEQ ID NO: 99617 - DNA, 17 bp, Artificial Sequence
  Synthetic
gtgggcgggcugttgua

SEQ ID NO: 99618 - DNA, 28 bp, Artificial Sequence
  Synthetic
caattcaaaautcagaguccaaccaaca

SEQ ID NO: 99619 - DNA, 21 bp, Artificial Sequence
  Synthetic
gctttgtgugtgaccugcaga

SEQ ID NO: 99620 - DNA, 18 bp, Artificial Sequence
  Synthetic
gtcgggcgagutgtucct

SEQ ID NO: 99621 - DNA, 19 bp, Artificial Sequence
  Synthetic
gctactuccgacagucgct

SEQ ID NO: 99622 - DNA, 20 bp, Artificial Sequence
  Synthetic
gggttguaagcctccaggua

SEQ ID NO: 99623 - DNA, 17 bp, Artificial Sequence
  Synthetic
acucccgcugcaaggac

SEQ ID NO: 99624 - DNA, 23 bp, Artificial Sequence
  Synthetic
tcctcgaagaucttgaccaggua

SEQ ID NO: 99625 - DNA, 23 bp, Artificial Sequence
  Synthetic
catcaacugggtcaaguacgact

SEQ ID NO: 99626 - DNA, 20 bp, Artificial Sequence
  Synthetic
ccatcactcgucggcatcug

SEQ ID NO: 99627 - DNA, 19 bp, Artificial Sequence
  Synthetic
ccgtggccuacgctacuat

SEQ ID NO: 99628 - DNA, 25 bp, Artificial Sequence
  Synthetic
cutaacaaggcucaaagaagaggga

SEQ ID NO: 99629 - DNA, 21 bp, Artificial Sequence
  Synthetic
tctcuccaagggctggtauct

SEQ ID NO: 99630 - DNA, 27 bp, Artificial Sequence
  Synthetic
tgtcttgtggaugatgtttttgtcgua

SEQ ID NO: 99631 - DNA, 28 bp, Artificial Sequence
  Synthetic
cttgtagattttugcctactcctcctut

SEQ ID NO: 99632 - DNA, 23 bp, Artificial Sequence
  Synthetic
gggacttgatutccaggcttcuc

SEQ ID NO: 99633 - DNA, 21 bp, Artificial Sequence
  Synthetic
agcucccugaacacacacaaa

SEQ ID NO: 99634 - DNA, 21 bp, Artificial Sequence
  Synthetic
cacccagaugcttcaggugag

SEQ ID NO: 99635 - DNA, 24 bp, Artificial Sequence
  Synthetic
ccaagcagaggacaucagcauaat

SEQ ID NO: 99636 - DNA, 27 bp, Artificial Sequence
  Synthetic
catacctggaacugaattagtggauga

SEQ ID NO: 99637 - DNA, 27 bp, Artificial Sequence
  Synthetic
aattggcaauccaaaaacgtttgacua

SEQ ID NO: 99638 - DNA, 25 bp, Artificial Sequence
  Synthetic
ccataggcucatttttcaggcuagt

SEQ ID NO: 99639 - DNA, 28 bp, Artificial Sequence
  Synthetic
gaactattugctttctctuccacacaaa

SEQ ID NO: 99640 - DNA, 25 bp, Artificial Sequence
  Synthetic
gctaacttcaucttccttcccauga

SEQ ID NO: 99641 - DNA, 20 bp, Artificial Sequence
  Synthetic
ccatctcccuccccctucag

SEQ ID NO: 99642 - DNA, 26 bp, Artificial Sequence
  Synthetic
ccauagtgttcuaagaacggaagcat

SEQ ID NO: 99643 - DNA, 19 bp, Artificial Sequence
  Synthetic
cagaacacucgcggtucac

SEQ ID NO: 99644 - DNA, 22 bp, Artificial Sequence
  Synthetic
gcctgttccauggcaccttaut

SEQ ID NO: 99645 - DNA, 28 bp, Artificial Sequence
  Synthetic
tgtgtagtcattuaccttggtcctgaua

SEQ ID NO: 99646 - DNA, 22 bp, Artificial Sequence
  Synthetic
gctcttgaccaucggaaacuct

SEQ ID NO: 99647 - DNA, 21 bp, Artificial Sequence
  Synthetic
aagaggagcutcaaggctgug

SEQ ID NO: 99648 - DNA, 27 bp, Artificial Sequence
  Synthetic
cagaaggagaagugagcaaaggaaaua

SEQ ID NO: 99649 - DNA, 25 bp, Artificial Sequence
  Synthetic
agaggctgccauaaatcgaaatuca

SEQ ID NO: 99650 - DNA, 24 bp, Artificial Sequence
  Synthetic
ttgccttugagttcagauccaact

SEQ ID NO: 99651 - DNA, 24 bp, Artificial Sequence
  Synthetic
gcattttctcuggattggcucaga

SEQ ID NO: 99652 - DNA, 18 bp, Artificial Sequence
  Synthetic
ggctcuccagcctcccua

SEQ ID NO: 99653 - DNA, 17 bp, Artificial Sequence
  Synthetic
gtgccccgcugacugat

SEQ ID NO: 99654 - DNA, 25 bp, Artificial Sequence
  Synthetic
aaaaatttccacuttgcgtctccug

SEQ ID NO: 99655 - DNA, 22 bp, Artificial Sequence
  Synthetic
ttgagcgcuaacgtctttcugt

SEQ ID NO: 99656 - DNA, 22 bp, Artificial Sequence
  Synthetic
gagccaauccagagaaaaugcc

SEQ ID NO: 99657 - DNA, 27 bp, Artificial Sequence
  Synthetic
tgacctactgagugtatacaactucct

SEQ ID NO: 99658 - DNA, 18 bp, Artificial Sequence
  Synthetic
gaagacuccgagcugcga

SEQ ID NO: 99659 - DNA, 23 bp, Artificial Sequence
  Synthetic
cacccgggaaguaagatcttuca

SEQ ID NO: 99660 - DNA, 27 bp, Artificial Sequence
  Synthetic
tggtggtaauggaagaggaagatuaga

SEQ ID NO: 99661 - DNA, 23 bp, Artificial Sequence
  Synthetic
ccttccccttucttgcccctaua

SEQ ID NO: 99662 - DNA, 23 bp, Artificial Sequence
  Synthetic
gggaccttgauggtttcttcuca

SEQ ID NO: 99663 - DNA, 25 bp, Artificial Sequence
  Synthetic
agggcuagataagcctuaacacaga

SEQ ID NO: 99664 - DNA, 23 bp, Artificial Sequence
  Synthetic
ggatcagttugctttgcatggug

SEQ ID NO: 99665 - DNA, 26 bp, Artificial Sequence
  Synthetic
caacaacactuactgtctccaugagt

SEQ ID NO: 99666 - DNA, 24 bp, Artificial Sequence
  Synthetic
gcccagagauactgaagcactuaa

SEQ ID NO: 99667 - DNA, 28 bp, Artificial Sequence
  Synthetic
gcagagaagcuggaacaatttuagaaaa

SEQ ID NO: 99668 - DNA, 21 bp, Artificial Sequence
  Synthetic
cccuttatuccagccgacaag

SEQ ID NO: 99669 - DNA, 25 bp, Artificial Sequence
  Synthetic
tttcagcutaatttcuggagagcca

SEQ ID NO: 99670 - DNA, 28 bp, Artificial Sequence
  Synthetic
agcattttcutcttctttauccaggaca

SEQ ID NO: 99671 - DNA, 28 bp, Artificial Sequence
  Synthetic
cccggatatatucaatgtcttcttugct

SEQ ID NO: 99672 - DNA, 28 bp, Artificial Sequence
  Synthetic
gcatatagcucatctccttuaccagaat

SEQ ID NO: 99673 - DNA, 27 bp, Artificial Sequence
  Synthetic
tcatcaugacagcatcttcugaagaac

SEQ ID NO: 99674 - DNA, 23 bp, Artificial Sequence
  Synthetic
gacatgctctutcctgcagttuc

SEQ ID NO: 99675 - DNA, 28 bp, Artificial Sequence
  Synthetic
aattgaaggactuttctgatcccttuca

SEQ ID NO: 99676 - DNA, 27 bp, Artificial Sequence
  Synthetic
ttcattttggaccuggagaaagttcut

SEQ ID NO: 99677 - DNA, 29 bp, Artificial Sequence
  Synthetic
gttttatagttcuctccagttgucaggat

SEQ ID NO: 99678 - DNA, 28 bp, Artificial Sequence
  Synthetic
tttagtctctgcgauatgataccagcua

SEQ ID NO: 99679 - DNA, 20 bp, Artificial Sequence
  Synthetic
tccuaccctguggcaacaac

SEQ ID NO: 99680 - DNA, 24 bp, Artificial Sequence
  Synthetic
caucgcauaagagcaaagaacact

SEQ ID NO: 99681 - DNA, 21 bp, Artificial Sequence
  Synthetic
caaggccugtgtcuaaaccgt

SEQ ID NO: 99682 - DNA, 23 bp, Artificial Sequence
  Synthetic
acctggugggctcaaaguaaaat

SEQ ID NO: 99683 - DNA, 28 bp, Artificial Sequence
  Synthetic
ggtgcaagtgtuaaaatatgagccttut

SEQ ID NO: 99684 - DNA, 22 bp, Artificial Sequence
  Synthetic
gacaggaaugccccagtuaaca

SEQ ID NO: 99685 - DNA, 26 bp, Artificial Sequence
  Synthetic
caattaaacugcacagtccatcctut

SEQ ID NO: 99686 - DNA, 32 bp, Artificial Sequence
  Synthetic
ttttcctactatacaucaccttcagagatcut

SEQ ID NO: 99687 - DNA, 23 bp, Artificial Sequence
  Synthetic
accaggacaccauttccatctug

SEQ ID NO: 99688 - DNA, 27 bp, Artificial Sequence
  Synthetic
cctggugaaacaaacagttcaaaguaa

SEQ ID NO: 99689 - DNA, 21 bp, Artificial Sequence
  Synthetic
gcaggugactaacauccccaa

SEQ ID NO: 99690 - DNA, 24 bp, Artificial Sequence
  Synthetic
cagattttguagccgatggatgug

SEQ ID NO: 99691 - DNA, 28 bp, Artificial Sequence
  Synthetic
actactctactcucttatggcaggtaug

SEQ ID NO: 99692 - DNA, 24 bp, Artificial Sequence
  Synthetic
acctggccaugatggttttctuaa

SEQ ID NO: 99693 - DNA, 23 bp, Artificial Sequence
  Synthetic
gctgttucagcagccaaagtauc

SEQ ID NO: 99694 - DNA, 23 bp, Artificial Sequence
  Synthetic
caagatggaaauggtgtccuggt

SEQ ID NO: 99695 - DNA, 27 bp, Artificial Sequence
  Synthetic
agtgccaatatucagaggcataagtut

SEQ ID NO: 99696 - DNA, 25 bp, Artificial Sequence
  Synthetic
cccctaacacuacccctaucaaaaa

SEQ ID NO: 99697 - DNA, 23 bp, Artificial Sequence
  Synthetic
tgttccttcucgccttgtttuct

SEQ ID NO: 99698 - DNA, 25 bp, Artificial Sequence
  Synthetic
ggaatcuagagagggcacaaucaag

SEQ ID NO: 99699 - DNA, 23 bp, Artificial Sequence
  Synthetic
ggcacaggutgtttggttacuca

SEQ ID NO: 99700 - DNA, 25 bp, Artificial Sequence
  Synthetic
tgatcagaucgaagttugcagagac

SEQ ID NO: 99701 - DNA, 28 bp, Artificial Sequence
  Synthetic
tccaagttcgaugattgctatgctaaut

SEQ ID NO: 99702 - DNA, 23 bp, Artificial Sequence
  Synthetic
acaaggtuaccaagcaguggaat

SEQ ID NO: 99703 - DNA, 28 bp, Artificial Sequence
  Synthetic
agagaacccugagggagataaaaatcut

SEQ ID NO: 99704 - DNA, 22 bp, Artificial Sequence
  Synthetic
gctgtgtucaccatagcuggaa

SEQ ID NO: 99705 - DNA, 27 bp, Artificial Sequence
  Synthetic
cgttgtgtttuaacaaagctcatcuct

SEQ ID NO: 99706 - DNA, 27 bp, Artificial Sequence
  Synthetic
tcattuttctatcctcauccagggaga

SEQ ID NO: 99707 - DNA, 28 bp, Artificial Sequence
  Synthetic
gctaaaccatcugactttcacttctuga

SEQ ID NO: 99708 - DNA, 20 bp, Artificial Sequence
  Synthetic
gggtcaccacaguggaacua

SEQ ID NO: 99709 - DNA, 27 bp, Artificial Sequence
  Synthetic
ttttacttttucaccccagactuacca

SEQ ID NO: 99710 - DNA, 19 bp, Artificial Sequence
  Synthetic
ctcaccugccctgtcctuc

SEQ ID NO: 99711 - DNA, 20 bp, Artificial Sequence
  Synthetic
atctcugggacccucacact

SEQ ID NO: 99712 - DNA, 21 bp, Artificial Sequence
  Synthetic
acctcccaucccgtatcctut

SEQ ID NO: 99713 - DNA, 26 bp, Artificial Sequence
  Synthetic
gacctttgaggagutccaggaatuac

SEQ ID NO: 99714 - DNA, 21 bp, Artificial Sequence
  Synthetic
tuctcatgtcugaagcgcagt

SEQ ID NO: 99715 - DNA, 27 bp, Artificial Sequence
  Synthetic
gctgtttttaaugccatctctctcuct

SEQ ID NO: 99716 - DNA, 22 bp, Artificial Sequence
  Synthetic
aaactgcccuttccgatcacut

SEQ ID NO: 99717 - DNA, 28 bp, Artificial Sequence
  Synthetic
agatgtcttcctutgaagcaatggtaut

SEQ ID NO: 99718 - DNA, 29 bp, Artificial Sequence
  Synthetic
ttttgctaugggaagacattagacugaaa

SEQ ID NO: 99719 - DNA, 26 bp, Artificial Sequence
  Synthetic
gacaggatatgutgacactccaaaug

SEQ ID NO: 99720 - DNA, 27 bp, Artificial Sequence
  Synthetic
caaaccagcttcuttccagagtaaauc

SEQ ID NO: 99721 - DNA, 26 bp, Artificial Sequence
  Synthetic
agutacagggcauaaaaggaaaagca

SEQ ID NO: 99722 - DNA, 21 bp, Artificial Sequence
  Synthetic
agagcagccgcaacutatugt

SEQ ID NO: 99723 - DNA, 25 bp, Artificial Sequence
  Synthetic
gtacaccctaagauctggaccttug

SEQ ID NO: 99724 - DNA, 22 bp, Artificial Sequence
  Synthetic
ggcaaauagcccatgtccucat

SEQ ID NO: 99725 - DNA, 18 bp, Artificial Sequence
  Synthetic
gacaccagucugccgaca

SEQ ID NO: 99726 - DNA, 33 bp, Artificial Sequence
  Synthetic
attattccgttauataaaacaatccucagaagt

SEQ ID NO: 99727 - DNA, 27 bp, Artificial Sequence
  Synthetic
tgttttgctguttatgcagtttuggat

SEQ ID NO: 99728 - DNA, 28 bp, Artificial Sequence
  Synthetic
tttcctgauggtctgatattuagaggga

SEQ ID NO: 99729 - DNA, 28 bp, Artificial Sequence
  Synthetic
tgatcatattuggaatgaaccacuggaa

SEQ ID NO: 99730 - DNA, 22 bp, Artificial Sequence
  Synthetic
cttgttcccauctccctcacuc

SEQ ID NO: 99731 - DNA, 20 bp, Artificial Sequence
  Synthetic
gtagagtcugcgcagtuggt

SEQ ID NO: 99732 - DNA, 20 bp, Artificial Sequence
  Synthetic
gacgtagaaccgucgctgut

SEQ ID NO: 99733 - DNA, 21 bp, Artificial Sequence
  Synthetic
ggagttcutcaacctguccca

SEQ ID NO: 99734 - DNA, 23 bp, Artificial Sequence
  Synthetic
tgttttgttgcaucttgcagcut

SEQ ID NO: 99735 - DNA, 28 bp, Artificial Sequence
  Synthetic
gactgtgaatguagaatctccaatcuct

SEQ ID NO: 99736 - DNA, 28 bp, Artificial Sequence
  Synthetic
cgagccattctuggtaagtcacaaauat

SEQ ID NO: 99737 - DNA, 28 bp, Artificial Sequence
  Synthetic
tgtttttgttttugtctgcttcgtuaca

SEQ ID NO: 99738 - DNA, 22 bp, Artificial Sequence
  Synthetic
gggaaagtguctgaagcaaugg

SEQ ID NO: 99739 - DNA, 28 bp, Artificial Sequence
  Synthetic
tgctgaaatcaucaggaatcaucaacat

SEQ ID NO: 99740 - DNA, 21 bp, Artificial Sequence
  Synthetic
gctgatgagggucaccagtug

SEQ ID NO: 99741 - DNA, 18 bp, Artificial Sequence
  Synthetic
cggtccugcttggugagg

SEQ ID NO: 99742 - DNA, 28 bp, Artificial Sequence
  Synthetic
gcaagcgugacaacaatttttatagugt

SEQ ID NO: 99743 - DNA, 28 bp, Artificial Sequence
  Synthetic
cgagaggagaaaagguagcagttaauga

SEQ ID NO: 99744 - DNA, 27 bp, Artificial Sequence
  Synthetic
ctcaacctactutttctgacgtcucat

SEQ ID NO: 99745 - DNA, 27 bp, Artificial Sequence
  Synthetic
tcaattgctgcaucaatgtcttcttug

SEQ ID NO: 99746 - DNA, 27 bp, Artificial Sequence
  Synthetic
cugactgtcaauaagaaccaaaggact

SEQ ID NO: 99747 - DNA, 27 bp, Artificial Sequence
  Synthetic
aggaguggagctcaaattuaacacaaa

SEQ ID NO: 99748 - DNA, 23 bp, Artificial Sequence
  Synthetic
gtgtgtgttcuatggcttgtugg

SEQ ID NO: 99749 - DNA, 22 bp, Artificial Sequence
  Synthetic
ccgctggcaaugctgtaacuat

SEQ ID NO: 99750 - DNA, 33 bp, Artificial Sequence
  Synthetic
cttagctacttgauattagatattgatcagugg

SEQ ID NO: 99751 - DNA, 28 bp, Artificial Sequence
  Synthetic
tttaggtctgtttucaacgtaagtccut

SEQ ID NO: 99752 - DNA, 18 bp, Artificial Sequence
  Synthetic
ggcagggaugggagguga

SEQ ID NO: 99753 - DNA, 22 bp, Artificial Sequence
  Synthetic
gctgcccugtatcctgttaucc

SEQ ID NO: 99754 - DNA, 27 bp, Artificial Sequence
  Synthetic
accatgucctgaattcaugaagaaact

SEQ ID NO: 99755 - DNA, 23 bp, Artificial Sequence
  Synthetic
gtgttcugagtcagcugggaaaa

SEQ ID NO: 99756 - DNA, 27 bp, Artificial Sequence
  Synthetic
gcaaaauggcaacaaatgaaaaatuct

SEQ ID NO: 99757 - DNA, 27 bp, Artificial Sequence
  Synthetic
tttgtggcuggtatacaauaacaaggt

SEQ ID NO: 99758 - DNA, 25 bp, Artificial Sequence
  Synthetic
cactccaacugaatccucaccaaat

SEQ ID NO: 99759 - DNA, 27 bp, Artificial Sequence
  Synthetic
actgaagttgacuaattttccccacut

SEQ ID NO: 99760 - DNA, 25 bp, Artificial Sequence
  Synthetic
tgatgagagtauctgttgggaucca

SEQ ID NO: 99761 - DNA, 26 bp, Artificial Sequence
  Synthetic
gcgtatttcccuactcaaaacaccua

SEQ ID NO: 99762 - DNA, 28 bp, Artificial Sequence
  Synthetic
gttgaaaacagaccuaaatatgcuggat

SEQ ID NO: 99763 - DNA, 23 bp, Artificial Sequence
  Synthetic
acacacacuacacaccccaaaug

SEQ ID NO: 99764 - DNA, 20 bp, Artificial Sequence
  Synthetic
ccatttgcccguccctctuc

SEQ ID NO: 99765 - DNA, 22 bp, Artificial Sequence
  Synthetic
gccatgttgcucttgttgagut

SEQ ID NO: 99766 - DNA, 22 bp, Artificial Sequence
  Synthetic
ccactgaauggtaaccauggca

SEQ ID NO: 99767 - DNA, 24 bp, Artificial Sequence
  Synthetic
gctcatggutgttcagguaagaag

SEQ ID NO: 99768 - DNA, 23 bp, Artificial Sequence
  Synthetic
agcuaggaagcaucacaaagaag

SEQ ID NO: 99769 - DNA, 20 bp, Artificial Sequence
  Synthetic
caccagutccaucgggaagg

SEQ ID NO: 99770 - DNA, 21 bp, Artificial Sequence
  Synthetic
tucagacaccaucgccaacat

SEQ ID NO: 99771 - DNA, 22 bp, Artificial Sequence
  Synthetic
ccacuccacacctctuggaaag

SEQ ID NO: 99772 - DNA, 28 bp, Artificial Sequence
  Synthetic
tctcaagtaaaagaagugtgggattgut

SEQ ID NO: 99773 - DNA, 33 bp, Artificial Sequence
  Synthetic
ctctcatgaaacatutttaaggacaaattctuc

SEQ ID NO: 99774 - DNA, 20 bp, Artificial Sequence
  Synthetic
cagggatugagggtcaggug

SEQ ID NO: 99775 - DNA, 22 bp, Artificial Sequence
  Synthetic
cgtggcgguagtgattgaugag

SEQ ID NO: 99776 - DNA, 24 bp, Artificial Sequence
  Synthetic
ggattctctccugtctgacaccut

SEQ ID NO: 99777 - DNA, 23 bp, Artificial Sequence
  Synthetic
gtaggugaggatgaaugggacac

SEQ ID NO: 99778 - DNA, 22 bp, Artificial Sequence
  Synthetic
tctccagucaccccauagagac

SEQ ID NO: 99779 - DNA, 21 bp, Artificial Sequence
  Synthetic
gcctaggttuggcatgcttut

SEQ ID NO: 99780 - DNA, 17 bp, Artificial Sequence
  Synthetic
ggcugaccggtgacugt

SEQ ID NO: 99781 - DNA, 17 bp, Artificial Sequence
  Synthetic
tcttgcugctccgcugt

SEQ ID NO: 99782 - DNA, 20 bp, Artificial Sequence
  Synthetic
tcaccttcugctccgttgug

SEQ ID NO: 99783 - DNA, 17 bp, Artificial Sequence
  Synthetic
cagccaggugcuaccct

SEQ ID NO: 99784 - DNA, 22 bp, Artificial Sequence
  Synthetic
cccaccatcutagtgctgauct

SEQ ID NO: 99785 - DNA, 21 bp, Artificial Sequence
  Synthetic
ccttttgtguatgccgaggug

SEQ ID NO: 99786 - DNA, 21 bp, Artificial Sequence
  Synthetic
tgtgtucacctgcaucaacca

SEQ ID NO: 99787 - DNA, 22 bp, Artificial Sequence
  Synthetic
tgaggaggcugatctgtgagut

SEQ ID NO: 99788 - DNA, 25 bp, Artificial Sequence
  Synthetic
tggtgaugccgaagatgtttacuac

SEQ ID NO: 99789 - DNA, 24 bp, Artificial Sequence
  Synthetic
gtcccauctttgttuggaggaact

SEQ ID NO: 99790 - DNA, 28 bp, Artificial Sequence
  Synthetic
aatttcaagaccaaguttggaaucaacc

SEQ ID NO: 99791 - DNA, 17 bp, Artificial Sequence
  Synthetic
gggcucaggcactcuca

SEQ ID NO: 99792 - DNA, 17 bp, Artificial Sequence
  Synthetic
gtgtccuggcctcgcua

SEQ ID NO: 99793 - DNA, 20 bp, Artificial Sequence
  Synthetic
cagtaggccuccaggaugag

SEQ ID NO: 99794 - DNA, 19 bp, Artificial Sequence
  Synthetic
gggtccugggaatccuggt

SEQ ID NO: 99795 - DNA, 21 bp, Artificial Sequence
  Synthetic
cgaggauggaggaggaaugga

SEQ ID NO: 99796 - DNA, 20 bp, Artificial Sequence
  Synthetic
tcaccutccagcuccgagat

SEQ ID NO: 99797 - DNA, 19 bp, Artificial Sequence
  Synthetic
ggatucccagacgcucagg

SEQ ID NO: 99798 - DNA, 21 bp, Artificial Sequence
  Synthetic
ccaaatgactucatcggcgut

SEQ ID NO: 99799 - DNA, 22 bp, Artificial Sequence
  Synthetic
cccccataucagtagcctgtug

SEQ ID NO: 99800 - DNA, 26 bp, Artificial Sequence
  Synthetic
agaatcacaaaagaauctggcugagt

SEQ ID NO: 99801 - DNA, 25 bp, Artificial Sequence
  Synthetic
cttcttatgtccutgggattgguga

SEQ ID NO: 99802 - DNA, 28 bp, Artificial Sequence
  Synthetic
ctgaaggaacucacttccaactataucc

SEQ ID NO: 99803 - DNA, 21 bp, Artificial Sequence
  Synthetic
gtggtuaaacgaggtggcauc

SEQ ID NO: 99804 - DNA, 19 bp, Artificial Sequence
  Synthetic
tgaccccucaccugaccat

SEQ ID NO: 99805 - DNA, 18 bp, Artificial Sequence
  Synthetic
cggaaggcgccaucucac

SEQ ID NO: 99806 - DNA, 27 bp, Artificial Sequence
  Synthetic
ctgagcccutttctttcttaugagaca

SEQ ID NO: 99807 - DNA, 21 bp, Artificial Sequence
  Synthetic
tccagaccaguacgtucgaga

SEQ ID NO: 99808 - DNA, 22 bp, Artificial Sequence
  Synthetic
gggagaagautgtgugggcaaa

SEQ ID NO: 99809 - DNA, 20 bp, Artificial Sequence
  Synthetic
aacgccutctcucacacagg

SEQ ID NO: 99810 - DNA, 27 bp, Artificial Sequence
  Synthetic
tttttgccttagugtctttgtgtugag

SEQ ID NO: 99811 - DNA, 28 bp, Artificial Sequence
  Synthetic
caatgcacattgcuttagagtgtcauaa

SEQ ID NO: 99812 - DNA, 22 bp, Artificial Sequence
  Synthetic
gcggcagcagugatggattuat

SEQ ID NO: 99813 - DNA, 26 bp, Artificial Sequence
  Synthetic
tgttggttccaauttctgtgtcauct

SEQ ID NO: 99814 - DNA, 21 bp, Artificial Sequence
  Synthetic
gggagguggtagtggaauaca

SEQ ID NO: 99815 - DNA, 23 bp, Artificial Sequence
  Synthetic
agcttgaggcugaaaagtagcut

SEQ ID NO: 99816 - DNA, 24 bp, Artificial Sequence
  Synthetic
ggagctugaaaggtagttaccugt

SEQ ID NO: 99817 - DNA, 21 bp, Artificial Sequence
  Synthetic
gctcgctcucctgtgtttcuc

SEQ ID NO: 99818 - DNA, 20 bp, Artificial Sequence
  Synthetic
agggaagggcuaaagccuca

SEQ ID NO: 99819 - DNA, 23 bp, Artificial Sequence
  Synthetic
ttcccactcuccctccttctuag

SEQ ID NO: 99820 - DNA, 24 bp, Artificial Sequence
  Synthetic
ctgtgaacaagcaaugtaggtgut

SEQ ID NO: 99821 - DNA, 24 bp, Artificial Sequence
  Synthetic
gtactccgguttcttcttccugac

SEQ ID NO: 99822 - DNA, 21 bp, Artificial Sequence
  Synthetic
ccaggcccacautgggtaaua

SEQ ID NO: 99823 - DNA, 24 bp, Artificial Sequence
  Synthetic
ccctccacuactcttaactgcuca

SEQ ID NO: 99824 - DNA, 29 bp, Artificial Sequence
  Synthetic
tgctaatgttggugttcttgtctttaugt

SEQ ID NO: 99825 - DNA, 23 bp, Artificial Sequence
  Synthetic
ggttcaugggaccacactgauaa

SEQ ID NO: 99826 - DNA, 26 bp, Artificial Sequence
  Synthetic
tcgugaaattaagctucagagggaag

SEQ ID NO: 99827 - DNA, 20 bp, Artificial Sequence
  Synthetic
catagccugggtgtgccuaa

SEQ ID NO: 99828 - DNA, 26 bp, Artificial Sequence
  Synthetic
tgaccatgatgutgtcactatgtcug

SEQ ID NO: 99829 - DNA, 21 bp, Artificial Sequence
  Synthetic
cgcttggaggcugaaaaccut

SEQ ID NO: 99830 - DNA, 20 bp, Artificial Sequence
  Synthetic
gcaggcagccuacagcauat

SEQ ID NO: 99831 - DNA, 28 bp, Artificial Sequence
  Synthetic
cccccattatttcugaaccagtttcaut

SEQ ID NO: 99832 - DNA, 21 bp, Artificial Sequence
  Synthetic
gtgagaggugggaacagtguc

SEQ ID NO: 99833 - DNA, 21 bp, Artificial Sequence
  Synthetic
ggaggtccaugctggtccuaa

SEQ ID NO: 99834 - DNA, 28 bp, Artificial Sequence
  Synthetic
tgaggagtatgtguatacatgtgagcut

SEQ ID NO: 99835 - DNA, 18 bp, Artificial Sequence
  Synthetic
agctcctugcccgactug

SEQ ID NO: 99836 - DNA, 24 bp, Artificial Sequence
  Synthetic
gaagatgaugccattgtccuggat

SEQ ID NO: 99837 - DNA, 23 bp, Artificial Sequence
  Synthetic
ccttctgguataatggtguggct

SEQ ID NO: 99838 - DNA, 19 bp, Artificial Sequence
  Synthetic
ggaguaccaccccgucagt

SEQ ID NO: 99839 - DNA, 21 bp, Artificial Sequence
  Synthetic
atgatttcucgggctuccaca

SEQ ID NO: 99840 - DNA, 24 bp, Artificial Sequence
  Synthetic
gaaagaugacagcatugaaggcat

SEQ ID NO: 99841 - DNA, 28 bp, Artificial Sequence
  Synthetic
ttgcttttagactugaatcccccttuaa

SEQ ID NO: 99842 - DNA, 21 bp, Artificial Sequence
  Synthetic
cacttccuctgtccccuacct

SEQ ID NO: 99843 - DNA, 17 bp, Artificial Sequence
  Synthetic
tccugcccggcacauac

SEQ ID NO: 99844 - DNA, 23 bp, Artificial Sequence
  Synthetic
gggaggcuccagacagatatcut

SEQ ID NO: 99845 - DNA, 28 bp, Artificial Sequence
  Synthetic
actcaaggtgtcutttgtatgtgctuag

SEQ ID NO: 99846 - DNA, 24 bp, Artificial Sequence
  Synthetic
gaggatagcguatttcccttucca

SEQ ID NO: 99847 - DNA, 28 bp, Artificial Sequence
  Synthetic
ccttttgtcucatggttgttattuccag

SEQ ID NO: 99848 - DNA, 20 bp, Artificial Sequence
  Synthetic
gcccuaccccaccatttucc

SEQ ID NO: 99849 - DNA, 27 bp, Artificial Sequence
  Synthetic
gacccctatgugaaaatttacctccut

SEQ ID NO: 99850 - DNA, 22 bp, Artificial Sequence
  Synthetic
aguatacuccaccgagaaccac

SEQ ID NO: 99851 - DNA, 22 bp, Artificial Sequence
  Synthetic
tcggcaugctggtauagagaga

SEQ ID NO: 99852 - DNA, 26 bp, Artificial Sequence
  Synthetic
ctcttttcacuatgactggagucagt

SEQ ID NO: 99853 - DNA, 20 bp, Artificial Sequence
  Synthetic
aagtgggcagugcagaugat

SEQ ID NO: 99854 - DNA, 22 bp, Artificial Sequence
  Synthetic
caaaucccagctcucgaagaga

SEQ ID NO: 99855 - DNA, 28 bp, Artificial Sequence
  Synthetic
gcaacacaacagutttaacttagtgcut

SEQ ID NO: 99856 - DNA, 25 bp, Artificial Sequence
  Synthetic
ggaacacaactugttcaatgtgcut

SEQ ID NO: 99857 - DNA, 21 bp, Artificial Sequence
  Synthetic
ggctggcagcugtgattcaua

SEQ ID NO: 99858 - DNA, 25 bp, Artificial Sequence
  Synthetic
caaatccttugaggcatcugcaaaa

SEQ ID NO: 99859 - DNA, 22 bp, Artificial Sequence
  Synthetic
gtagcagggaggcutatuccag

SEQ ID NO: 99860 - DNA, 25 bp, Artificial Sequence
  Synthetic
cctgacagtauccctctcttcctut

SEQ ID NO: 99861 - DNA, 19 bp, Artificial Sequence
  Synthetic
ggtgguccagtccgucaag

SEQ ID NO: 99862 - DNA, 24 bp, Artificial Sequence
  Synthetic
cttagtggtuttctgagggucagg

SEQ ID NO: 99863 - DNA, 28 bp, Artificial Sequence
  Synthetic
aatggtggugaagagacagatgtuaaaa

SEQ ID NO: 99864 - DNA, 22 bp, Artificial Sequence
  Synthetic
ggccacaagaugagguggaaat

SEQ ID NO: 99865 - DNA, 23 bp, Artificial Sequence
  Synthetic
gtcaaccugaaggtgactgtgut

SEQ ID NO: 99866 - DNA, 19 bp, Artificial Sequence
  Synthetic
gctcagugatcgccuccaa

SEQ ID NO: 99867 - DNA, 21 bp, Artificial Sequence
  Synthetic
gatatgtggcucctgggagug

SEQ ID NO: 99868 - DNA, 21 bp, Artificial Sequence
  Synthetic
ctggtugagagcactggugat

SEQ ID NO: 99869 - DNA, 22 bp, Artificial Sequence
  Synthetic
ggtuggagaccaagagcaugag

SEQ ID NO: 99870 - DNA, 28 bp, Artificial Sequence
  Synthetic
atatttcaaaaugtaacggucccagaga

SEQ ID NO: 99871 - DNA, 25 bp, Artificial Sequence
  Synthetic
tcgcctgguacaggaacauaaaaag

SEQ ID NO: 99872 - DNA, 27 bp, Artificial Sequence
  Synthetic
tgggtatacuctggcagaaauacaaga

SEQ ID NO: 99873 - DNA, 21 bp, Artificial Sequence
  Synthetic
tcaaacaugcctgggugaaca

SEQ ID NO: 99874 - DNA, 26 bp, Artificial Sequence
  Synthetic
tgttggattttuacctagcacugcaa

SEQ ID NO: 99875 - DNA, 24 bp, Artificial Sequence
  Synthetic
gagggucaagucacagacaagaag

SEQ ID NO: 99876 - DNA, 24 bp, Artificial Sequence
  Synthetic
ccccaaaggaaacuactctcgaut

SEQ ID NO: 99877 - DNA, 19 bp, Artificial Sequence
  Synthetic
aggguccccagagcttgua

SEQ ID NO: 99878 - DNA, 24 bp, Artificial Sequence
  Synthetic
tggcagttgacuagtatcccaugt

SEQ ID NO: 99879 - DNA, 21 bp, Artificial Sequence
  Synthetic
ccaggaacauccaggugaagg

SEQ ID NO: 99880 - DNA, 22 bp, Artificial Sequence
  Synthetic
tggagguagagcccagttaugg

SEQ ID NO: 99881 - DNA, 29 bp, Artificial Sequence
  Synthetic
cccttcctgtacutaaattgccttgauat

SEQ ID NO: 99882 - DNA, 23 bp, Artificial Sequence
  Synthetic
caactctgcutaggactcuggat

SEQ ID NO: 99883 - DNA, 27 bp, Artificial Sequence
  Synthetic
tgcatgagacacutactgtgtauaagg

SEQ ID NO: 99884 - DNA, 21 bp, Artificial Sequence
  Synthetic
ggaaacacuggtgacugcaca

SEQ ID NO: 99885 - DNA, 23 bp, Artificial Sequence
  Synthetic
ggttcttcucagctgatgtugct

SEQ ID NO: 99886 - DNA, 28 bp, Artificial Sequence
  Synthetic
gctggtagtaaguagaaaggcttttgut

SEQ ID NO: 99887 - DNA, 33 bp, Artificial Sequence
  Synthetic
tgaatttttccatcaugtgtaatattatguggt

SEQ ID NO: 99888 - DNA, 26 bp, Artificial Sequence
  Synthetic
ctgccctgtuacatttcttcttctug

SEQ ID NO: 99889 - DNA, 21 bp, Artificial Sequence
  Synthetic
ctgacacagccacaaugagug

SEQ ID NO: 99890 - DNA, 21 bp, Artificial Sequence
  Synthetic
gcctctugaagcctgucacac

SEQ ID NO: 99891 - DNA, 24 bp, Artificial Sequence
  Synthetic
tctaaaggcacagugagggtttut

SEQ ID NO: 99892 - DNA, 26 bp, Artificial Sequence
  Synthetic
catatgaatucacaaggagugaggga

SEQ ID NO: 99893 - DNA, 24 bp, Artificial Sequence
  Synthetic
tgacatucagacacacaugaccaa

SEQ ID NO: 99894 - DNA, 24 bp, Artificial Sequence
  Synthetic
ggcctaucagattcaagtugcaag

SEQ ID NO: 99895 - DNA, 28 bp, Artificial Sequence
  Synthetic
cgtgttctccaugttgattctttgttut

SEQ ID NO: 99896 - DNA, 29 bp, Artificial Sequence
  Synthetic
cttttcctttcutttgacttcagaugcaa

SEQ ID NO: 99897 - DNA, 26 bp, Artificial Sequence
  Synthetic
acacattcatacugcacttcaaggua

SEQ ID NO: 99898 - DNA, 24 bp, Artificial Sequence
  Synthetic
ttttatctggucggctatgggaug

SEQ ID NO: 99899 - DNA, 24 bp, Artificial Sequence
  Synthetic
acctttgctuccaagaaaguccaa

SEQ ID NO: 99900 - DNA, 23 bp, Artificial Sequence
  Synthetic
acccgtguccaggaacctauaaa

SEQ ID NO: 99901 - DNA, 23 bp, Artificial Sequence
  Synthetic
tgucaatgcaugcaaaacacagt

SEQ ID NO: 99902 - DNA, 18 bp, Artificial Sequence
  Synthetic
caguccgcucagcaggaa

SEQ ID NO: 99903 - DNA, 17 bp, Artificial Sequence
  Synthetic
ccggtcgcuctcgtcug

SEQ ID NO: 99904 - DNA, 21 bp, Artificial Sequence
  Synthetic
caagcagcacuccccttgtua

SEQ ID NO: 99905 - DNA, 28 bp, Artificial Sequence
  Synthetic
tgttggccttguaacttttgatgtttut

SEQ ID NO: 99906 - DNA, 22 bp, Artificial Sequence
  Synthetic
gagaaccccucttuggaaagca

SEQ ID NO: 99907 - DNA, 21 bp, Artificial Sequence
  Synthetic
tggaucaagagcccaatgguc

SEQ ID NO: 99908 - DNA, 18 bp, Artificial Sequence
  Synthetic
ccgcccuccttcctggua

SEQ ID NO: 99909 - DNA, 20 bp, Artificial Sequence
  Synthetic
gtcacaccaucccctgaucc

SEQ ID NO: 99910 - DNA, 28 bp, Artificial Sequence
  Synthetic
ttcaatcatttcaugcatagaggtccut

SEQ ID NO: 99911 - DNA, 28 bp, Artificial Sequence
  Synthetic
aatccaatgggaacugttcaaacaaauc

SEQ ID NO: 99912 - DNA, 28 bp, Artificial Sequence
  Synthetic
tgcaaagctgtugcattttcagtataug

SEQ ID NO: 99913 - DNA, 27 bp, Artificial Sequence
  Synthetic
tctaaggugattttcaugggaggagat

SEQ ID NO: 99914 - DNA, 21 bp, Artificial Sequence
  Synthetic
acacgtgtcuacctcccacut

SEQ ID NO: 99915 - DNA, 29 bp, Artificial Sequence
  Synthetic
gaagcttcatatuctctttctcccttuct

SEQ ID NO: 99916 - DNA, 19 bp, Artificial Sequence
  Synthetic
cccccagaugctctaccug

SEQ ID NO: 99917 - DNA, 19 bp, Artificial Sequence
  Synthetic
agcugccctcuggagaagt

SEQ ID NO: 99918 - DNA, 25 bp, Artificial Sequence
  Synthetic
gaatgttgtctuacctgaccaggut

SEQ ID NO: 99919 - DNA, 28 bp, Artificial Sequence
  Synthetic
cacgctttttguctgtttgactagatut

SEQ ID NO: 99920 - DNA, 22 bp, Artificial Sequence
  Synthetic
gactcugatgcttguccacact

SEQ ID NO: 99921 - DNA, 23 bp, Artificial Sequence
  Synthetic
ttctcctttcaugagctcccauc

SEQ ID NO: 99922 - DNA, 20 bp, Artificial Sequence
  Synthetic
cccuttccugagaccagcaa

SEQ ID NO: 99923 - DNA, 21 bp, Artificial Sequence
  Synthetic
gagagtccaugtcacccucac

SEQ ID NO: 99924 - DNA, 20 bp, Artificial Sequence
  Synthetic
gcatcccucctggagagcua

SEQ ID NO: 99925 - DNA, 28 bp, Artificial Sequence
  Synthetic
ccaguatcaaauaaccaacaaaagcaca

SEQ ID NO: 99926 - DNA, 22 bp, Artificial Sequence
  Synthetic
cttcaacacugaccacugcaat

SEQ ID NO: 99927 - DNA, 25 bp, Artificial Sequence
  Synthetic
cttcagctutttcacccucaagaag

SEQ ID NO: 99928 - DNA, 21 bp, Artificial Sequence
  Synthetic
agaaaucctcugcggcaagac

SEQ ID NO: 99929 - DNA, 23 bp, Artificial Sequence
  Synthetic
gattttgtugacctttgcugcca

SEQ ID NO: 99930 - DNA, 23 bp, Artificial Sequence
  Synthetic
ctcagagccaccautaaggtgut

SEQ ID NO: 99931 - DNA, 22 bp, Artificial Sequence
  Synthetic
ggtaacugaaccagagugcaga

SEQ ID NO: 99932 - DNA, 22 bp, Artificial Sequence
  Synthetic
agtggccgaugactttgtacuc

SEQ ID NO: 99933 - DNA, 26 bp, Artificial Sequence
  Synthetic
cccagtgggcuatcttactaaaacut

SEQ ID NO: 99934 - DNA, 23 bp, Artificial Sequence
  Synthetic
actaccauggccaaaaaggctua

SEQ ID NO: 99935 - DNA, 20 bp, Artificial Sequence
  Synthetic
ggagcagtguggagagctug

SEQ ID NO: 99936 - DNA, 20 bp, Artificial Sequence
  Synthetic
ctcttgcccucagaggtugg

SEQ ID NO: 99937 - DNA, 25 bp, Artificial Sequence
  Synthetic
cccatttgccaucttcctcctttua

SEQ ID NO: 99938 - DNA, 21 bp, Artificial Sequence
  Synthetic
ttgcgaaugaggttguaggct

SEQ ID NO: 99939 - DNA, 27 bp, Artificial Sequence
  Synthetic
ccatgttgaccutctacctgtatgtuc

SEQ ID NO: 99940 - DNA, 27 bp, Artificial Sequence
  Synthetic
tctgaattaaatuccgcaccatacuga

SEQ ID NO: 99941 - DNA, 27 bp, Artificial Sequence
  Synthetic
aggtgctgatauggaagaatttcaugg

SEQ ID NO: 99942 - DNA, 21 bp, Artificial Sequence
  Synthetic
gtgtcctaggguctccacauc

SEQ ID NO: 99943 - DNA, 27 bp, Artificial Sequence
  Synthetic
ccttttcatcauatgttctccccucaa

SEQ ID NO: 99944 - DNA, 21 bp, Artificial Sequence
  Synthetic
catctgaugggatcccugcac

SEQ ID NO: 99945 - DNA, 23 bp, Artificial Sequence
  Synthetic
gcccctctcugaataggtcacut

SEQ ID NO: 99946 - DNA, 20 bp, Artificial Sequence
  Synthetic
cgtcatcgugcaaagtccug

SEQ ID NO: 99947 - DNA, 28 bp, Artificial Sequence
  Synthetic
ttgctctttagtcugttgagcttacaut

SEQ ID NO: 99948 - DNA, 25 bp, Artificial Sequence
  Synthetic
ggtcttctggauacacaggtaguga

SEQ ID NO: 99949 - DNA, 21 bp, Artificial Sequence
  Synthetic
ggguaacccgacacttuggac

SEQ ID NO: 99950 - DNA, 32 bp, Artificial Sequence
  Synthetic
ctaattctaaaaacuacgttttcatugcacct

SEQ ID NO: 99951 - DNA, 27 bp, Artificial Sequence
  Synthetic
ggcagtgttugaacagcattguaaaat

SEQ ID NO: 99952 - DNA, 30 bp, Artificial Sequence
  Synthetic
ctgtttgaactutcatatattcttgugcca

SEQ ID NO: 99953 - DNA, 28 bp, Artificial Sequence
  Synthetic
ctctgtcttgacuctcatcttagcuaga

SEQ ID NO: 99954 - DNA, 21 bp, Artificial Sequence
  Synthetic
tgggucaagccagtacagaua

SEQ ID NO: 99955 - DNA, 22 bp, Artificial Sequence
  Synthetic
cccagacaaucgaggttguagt

SEQ ID NO: 99956 - DNA, 28 bp, Artificial Sequence
  Synthetic
acttacagaatccaugagataggctuct

SEQ ID NO: 99957 - DNA, 28 bp, Artificial Sequence
  Synthetic
ggaatagcagacucatatggtttgauct

SEQ ID NO: 99958 - DNA, 26 bp, Artificial Sequence
  Synthetic
aaatacaacgtuggtgatttggtgug

SEQ ID NO: 99959 - DNA, 27 bp, Artificial Sequence
  Synthetic
aagcctggagaugagaaagattaagug

SEQ ID NO: 99960 - DNA, 20 bp, Artificial Sequence
  Synthetic
cacucccgacuacagggaac

SEQ ID NO: 99961 - DNA, 20 bp, Artificial Sequence
  Synthetic
agcctccuttgcggguaaac

SEQ ID NO: 99962 - DNA, 21 bp, Artificial Sequence
  Synthetic
actactugccgccagaaauga

SEQ ID NO: 99963 - DNA, 21 bp, Artificial Sequence
  Synthetic
tgaaugcccaaaggtgacugt

SEQ ID NO: 99964 - DNA, 24 bp, Artificial Sequence
  Synthetic
augctttttaatctuccccaccca

SEQ ID NO: 99965 - DNA, 20 bp, Artificial Sequence
  Synthetic
tgcccacuctctcggaucat

SEQ ID NO: 99966 - DNA, 22 bp, Artificial Sequence
  Synthetic
tgctcagggcaaucttgcaaua

SEQ ID NO: 99967 - DNA, 23 bp, Artificial Sequence
  Synthetic
gtactaugaccgaaaugccgaga

SEQ ID NO: 99968 - DNA, 19 bp, Artificial Sequence
  Synthetic
gccgcagcucgttcaugat

SEQ ID NO: 99969 - DNA, 19 bp, Artificial Sequence
  Synthetic
gcagtcacagugcccugag

SEQ ID NO: 99970 - DNA, 17 bp, Artificial Sequence
  Synthetic
tgcugggcatuggcgat

SEQ ID NO: 99971 - DNA, 19 bp, Artificial Sequence
  Synthetic
gccacagagcugtgtgcua

SEQ ID NO: 99972 - DNA, 21 bp, Artificial Sequence
  Synthetic
cagggacggagcugactttua

SEQ ID NO: 99973 - DNA, 22 bp, Artificial Sequence
  Synthetic
agugcaaaaugccaacacagag

SEQ ID NO: 99974 - DNA, 21 bp, Artificial Sequence
  Synthetic
gggagacaagcugcacttuga

SEQ ID NO: 99975 - DNA, 21 bp, Artificial Sequence
  Synthetic
ctcucccacctaucccaggag

SEQ ID NO: 99976 - DNA, 21 bp, Artificial Sequence
  Synthetic
cctgguccttctccugacact

SEQ ID NO: 99977 - DNA, 19 bp, Artificial Sequence
  Synthetic
catcggcaucgccaactuc

SEQ ID NO: 99978 - DNA, 21 bp, Artificial Sequence
  Synthetic
ctcaguggaggcgtacaucac

SEQ ID NO: 99979 - DNA, 21 bp, Artificial Sequence
  Synthetic
cagaggtgguggtgttgctua

SEQ ID NO: 99980 - DNA, 20 bp, Artificial Sequence
  Synthetic
gcatccggcucatgcauaca

SEQ ID NO: 99981 - DNA, 21 bp, Artificial Sequence
  Synthetic
gcgucagccaaagaaggacuc

SEQ ID NO: 99982 - DNA, 28 bp, Artificial Sequence
  Synthetic
tcccagaacaacucatgtgttauagaga

SEQ ID NO: 99983 - DNA, 23 bp, Artificial Sequence
  Synthetic
aagacagccugattcaggttuca

SEQ ID NO: 99984 - DNA, 24 bp, Artificial Sequence
  Synthetic
tgaaacctgaaucaggctgtctug

SEQ ID NO: 99985 - DNA, 28 bp, Artificial Sequence
  Synthetic
tttagcaaagacaauacacccatatuct

SEQ ID NO: 99986 - DNA, 21 bp, Artificial Sequence
  Synthetic
gcaacuccacacagccaauct

SEQ ID NO: 99987 - DNA, 20 bp, Artificial Sequence
  Synthetic
ccaugggcgagaagtgtguc

SEQ ID NO: 99988 - DNA, 23 bp, Artificial Sequence
  Synthetic
gtctcguttctgagtugacagca

SEQ ID NO: 99989 - DNA, 28 bp, Artificial Sequence
  Synthetic
cctgaaatgaacucagcgattctctaua

SEQ ID NO: 99990 - DNA, 19 bp, Artificial Sequence
  Synthetic
caccgtucatgacguggag

SEQ ID NO: 99991 - DNA, 21 bp, Artificial Sequence
  Synthetic
ctcauccagccctgtctucaa

SEQ ID NO: 99992 - DNA, 19 bp, Artificial Sequence
  Synthetic
gcagcccgutggugaacat

SEQ ID NO: 99993 - DNA, 21 bp, Artificial Sequence
  Synthetic
tcauaccaagcaggccttugg

SEQ ID NO: 99994 - DNA, 26 bp, Artificial Sequence
  Synthetic
gtttttctttccuttcttggcctugt

SEQ ID NO: 99995 - DNA, 26 bp, Artificial Sequence
  Synthetic
attcagacaucagatgggtttuaggg

SEQ ID NO: 99996 - DNA, 17 bp, Artificial Sequence
  Synthetic
caggccugccucacact

SEQ ID NO: 99997 - DNA, 18 bp, Artificial Sequence
  Synthetic
cgtauccagagggugcca

SEQ ID NO: 99998 - DNA, 23 bp, Artificial Sequence
  Synthetic
tcagctaagaaaugctgguccac

SEQ ID NO: 99999 - DNA, 25 bp, Artificial Sequence
  Synthetic
gagcgagugccttttattctuacct

SEQ ID NO: 100000 - DNA, 26 bp, Artificial Sequence
  Synthetic
acagtgactuaaagtagctgcttucc

SEQ ID NO: 100001 - DNA, 22 bp, Artificial Sequence
  Synthetic
gatctgagcaguggaagctgua

SEQ ID NO: 100002 - DNA, 17 bp, Artificial Sequence
  Synthetic
cgagggugggtgctguc

SEQ ID NO: 100003 - DNA, 22 bp, Artificial Sequence
  Synthetic
ttctttgcccutcctggatcuc

SEQ ID NO: 100004 - DNA, 21 bp, Artificial Sequence
  Synthetic
caaggacauagccaagcuggt

SEQ ID NO: 100005 - DNA, 28 bp, Artificial Sequence
  Synthetic
ctcagtgtagcagutctatatggttgut

SEQ ID NO: 100006 - DNA, 21 bp, Artificial Sequence
  Synthetic
ccuaagacccccagacuccag

SEQ ID NO: 100007 - DNA, 21 bp, Artificial Sequence
  Synthetic
tccccatgcaugtctctccua

SEQ ID NO: 100008 - DNA, 20 bp, Artificial Sequence
  Synthetic
gttgggagutgctuggaggt

SEQ ID NO: 100009 - DNA, 20 bp, Artificial Sequence
  Synthetic
gctcacgacccucgctatug

SEQ ID NO: 100010 - DNA, 22 bp, Artificial Sequence
  Synthetic
ggaagcucagactgtccucaga

SEQ ID NO: 100011 - DNA, 23 bp, Artificial Sequence
  Synthetic
ccugaacaagagcctgtaucact

SEQ ID NO: 100012 - DNA, 28 bp, Artificial Sequence
  Synthetic
ccttgttgaaugacatggatgaaaucat

SEQ ID NO: 100013 - DNA, 28 bp, Artificial Sequence
  Synthetic
gaacccaccagaaaaaugaaggaaatua

SEQ ID NO: 100014 - DNA, 22 bp, Artificial Sequence
  Synthetic
gtttacttatugccccgaugcc

SEQ ID NO: 100015 - DNA, 21 bp, Artificial Sequence
  Synthetic
tctccctguaaggctggtugt

SEQ ID NO: 100016 - DNA, 22 bp, Artificial Sequence
  Synthetic
cagtcttuggccgggttcttua

SEQ ID NO: 100017 - DNA, 24 bp, Artificial Sequence
  Synthetic
gccatccccaaaaguctgttagug

SEQ ID NO: 100018 - DNA, 28 bp, Artificial Sequence
  Synthetic
ctggtttttautatgtggguaagaagca

SEQ ID NO: 100019 - DNA, 24 bp, Artificial Sequence
  Synthetic
gccaccaucacaacaaaagcatut

SEQ ID NO: 100020 - DNA, 23 bp, Artificial Sequence
  Synthetic
ctgaaggucgcaatgatgatguc

SEQ ID NO: 100021 - DNA, 28 bp, Artificial Sequence
  Synthetic
gcctacttctttuaagcacagagtttut

SEQ ID NO: 100022 - DNA, 25 bp, Artificial Sequence
  Synthetic
tgtgttcattugacctgacagtugt

SEQ ID NO: 100023 - DNA, 23 bp, Artificial Sequence
  Synthetic
gagguggcaaaatgaagucgaag

SEQ ID NO: 100024 - DNA, 23 bp, Artificial Sequence
  Synthetic
gagatctcugaagttccuggagt

SEQ ID NO: 100025 - DNA, 25 bp, Artificial Sequence
  Synthetic
tctttttgcccutttcctctgauga

SEQ ID NO: 100026 - DNA, 21 bp, Artificial Sequence
  Synthetic
attgugacgtgtguggcaaac

SEQ ID NO: 100027 - DNA, 21 bp, Artificial Sequence
  Synthetic
gtcttggugcttcugaccgat

SEQ ID NO: 100028 - DNA, 27 bp, Artificial Sequence
  Synthetic
aacatttcctcagaguagactcctgua

SEQ ID NO: 100029 - DNA, 29 bp, Artificial Sequence
  Synthetic
acccacttactucttacactttacucact

SEQ ID NO: 100030 - DNA, 19 bp, Artificial Sequence
  Synthetic
gacggctucccttgtggua

SEQ ID NO: 100031 - DNA, 19 bp, Artificial Sequence
  Synthetic
cutctggccuccgggaaag

SEQ ID NO: 100032 - DNA, 18 bp, Artificial Sequence
  Synthetic
cugcggagcttuccacct

SEQ ID NO: 100033 - DNA, 18 bp, Artificial Sequence
  Synthetic
cagcucagggcaggacut

SEQ ID NO: 100034 - DNA, 23 bp, Artificial Sequence
  Synthetic
cctactgctgugagcatgactua

SEQ ID NO: 100035 - DNA, 17 bp, Artificial Sequence
  Synthetic
cccuggauccggccaag

SEQ ID NO: 100036 - DNA, 26 bp, Artificial Sequence
  Synthetic
gcaaacaugatcgtugaaagaaagca

SEQ ID NO: 100037 - DNA, 21 bp, Artificial Sequence
  Synthetic
ttgtctgtucagccagctcuc

SEQ ID NO: 100038 - DNA, 19 bp, Artificial Sequence
  Synthetic
gcgacgugctggtagugag

SEQ ID NO: 100039 - DNA, 21 bp, Artificial Sequence
  Synthetic
ccccaggaacuccacauaggt

SEQ ID NO: 100040 - DNA, 17 bp, Artificial Sequence
  Synthetic
cggcagcgaggugacut

SEQ ID NO: 100041 - DNA, 17 bp, Artificial Sequence
  Synthetic
ccctgcutgctgcucac

SEQ ID NO: 100042 - DNA, 22 bp, Artificial Sequence
  Synthetic
gaaacagcugccaacattgcua

SEQ ID NO: 100043 - DNA, 20 bp, Artificial Sequence
  Synthetic
aaacuccgggcagcactauc

SEQ ID NO: 100044 - DNA, 21 bp, Artificial Sequence
  Synthetic
ctctagaccucgacgacccut

SEQ ID NO: 100045 - DNA, 20 bp, Artificial Sequence
  Synthetic
gcagaacutgcggucacaca

SEQ ID NO: 100046 - DNA, 20 bp, Artificial Sequence
  Synthetic
cagucagaggacgagtgcut

SEQ ID NO: 100047 - DNA, 18 bp, Artificial Sequence
  Synthetic
aucaggagccugccacac

SEQ ID NO: 100048 - DNA, 22 bp, Artificial Sequence
  Synthetic
gaactugaccccagguggaaaa

SEQ ID NO: 100049 - DNA, 27 bp, Artificial Sequence
  Synthetic
aaggaggaaaatuaagcagtgaaguct

SEQ ID NO: 100050 - DNA, 17 bp, Artificial Sequence
  Synthetic
cgctcccaggucgcaua

SEQ ID NO: 100051 - DNA, 18 bp, Artificial Sequence
  Synthetic
catttgcgcuggctggug

SEQ ID NO: 100052 - DNA, 19 bp, Artificial Sequence
  Synthetic
aggagucccaagcctucca

SEQ ID NO: 100053 - DNA, 19 bp, Artificial Sequence
  Synthetic
ggtgcauggcgtagagcut

SEQ ID NO: 100054 - DNA, 29 bp, Artificial Sequence
  Synthetic
gagatgggtgacuacaaaacatacttuct

SEQ ID NO: 100055 - DNA, 26 bp, Artificial Sequence
  Synthetic
gatatgctccggcuagttacaatuct

SEQ ID NO: 100056 - DNA, 20 bp, Artificial Sequence
  Synthetic
ctcatccccaucgagtucgt

SEQ ID NO: 100057 - DNA, 19 bp, Artificial Sequence
  Synthetic
cagccgguggtagaagucc

SEQ ID NO: 100058 - DNA, 20 bp, Artificial Sequence
  Synthetic
ggcaacguggagcagaugaa

SEQ ID NO: 100059 - DNA, 20 bp, Artificial Sequence
  Synthetic
caguccagagtcugcaccac

SEQ ID NO: 100060 - DNA, 22 bp, Artificial Sequence
  Synthetic
gctttgggauagtctgtgcuca

SEQ ID NO: 100061 - DNA, 27 bp, Artificial Sequence
  Synthetic
gctttatcaccuaacagcacgatguat

SEQ ID NO: 100062 - DNA, 21 bp, Artificial Sequence
  Synthetic
cgacgaugagctggagtucac

SEQ ID NO: 100063 - DNA, 25 bp, Artificial Sequence
  Synthetic
gaatgacgaugaagatgcagttgut

SEQ ID NO: 100064 - DNA, 25 bp, Artificial Sequence
  Synthetic
gtacgagauctacgacaaguaccag

SEQ ID NO: 100065 - DNA, 23 bp, Artificial Sequence
  Synthetic
tcagtgacgucatagccaaucag

SEQ ID NO: 100066 - DNA, 23 bp, Artificial Sequence
  Synthetic
agtacctguggaagaagatugcc

SEQ ID NO: 100067 - DNA, 22 bp, Artificial Sequence
  Synthetic
tcgctttggcuttcgggaauat

SEQ ID NO: 100068 - DNA, 21 bp, Artificial Sequence
  Synthetic
gggacaggaguagtctuccaa

SEQ ID NO: 100069 - DNA, 19 bp, Artificial Sequence
  Synthetic
auaacgcgucggaaaccct

SEQ ID NO: 100070 - DNA, 21 bp, Artificial Sequence
  Synthetic
ctgggccaccaauctcaucaa

SEQ ID NO: 100071 - DNA, 28 bp, Artificial Sequence
  Synthetic
ccattgtttcugtaagtcatguggaaaa

SEQ ID NO: 100072 - DNA, 22 bp, Artificial Sequence
  Synthetic
gccaccutctgattugggaagt

SEQ ID NO: 100073 - DNA, 28 bp, Artificial Sequence
  Synthetic
gagctactgcautttgactgagatttut

SEQ ID NO: 100074 - DNA, 20 bp, Artificial Sequence
  Synthetic
gagugtgagggucccagaga

SEQ ID NO: 100075 - DNA, 18 bp, Artificial Sequence
  Synthetic
cucgggcaggcagaugag

SEQ ID NO: 100076 - DNA, 24 bp, Artificial Sequence
  Synthetic
atgataggccucagggagaaauct

SEQ ID NO: 100077 - DNA, 20 bp, Artificial Sequence
  Synthetic
gctcaccccutggagcauat

SEQ ID NO: 100078 - DNA, 22 bp, Artificial Sequence
  Synthetic
gcaguaaccccaacacggauag

SEQ ID NO: 100079 - DNA, 20 bp, Artificial Sequence
  Synthetic
tcugaagagcuccaggagca

SEQ ID NO: 100080 - DNA, 23 bp, Artificial Sequence
  Synthetic
gagactgacucccatctcagcua

SEQ ID NO: 100081 - DNA, 17 bp, Artificial Sequence
  Synthetic
tggugagccgcaucgac

SEQ ID NO: 100082 - DNA, 24 bp, Artificial Sequence
  Synthetic
tggccaagaagaaauctctgaugg

SEQ ID NO: 100083 - DNA, 20 bp, Artificial Sequence
  Synthetic
cgtgtccaguaccacgugaa

SEQ ID NO: 100084 - DNA, 20 bp, Artificial Sequence
  Synthetic
ctgcttuccaccacctcgua

SEQ ID NO: 100085 - DNA, 21 bp, Artificial Sequence
  Synthetic
gtcatgacccuggaccugaag

SEQ ID NO: 100086 - DNA, 21 bp, Artificial Sequence
  Synthetic
ccgggtguacctgattcugga

SEQ ID NO: 100087 - DNA, 22 bp, Artificial Sequence
  Synthetic
cagcccacaguaaacucagaga

SEQ ID NO: 100088 - DNA, 18 bp, Artificial Sequence
  Synthetic
ggcuggcaggtgagugac

SEQ ID NO: 100089 - DNA, 19 bp, Artificial Sequence
  Synthetic
gcttgccacucagcatcuc

SEQ ID NO: 100090 - DNA, 21 bp, Artificial Sequence
  Synthetic
tggtacgugggcaagaucaac

SEQ ID NO: 100091 - DNA, 22 bp, Artificial Sequence
  Synthetic
gcattcaaugagagctcuggga

SEQ ID NO: 100092 - DNA, 21 bp, Artificial Sequence
  Synthetic
acugccucaagaacggagaag

SEQ ID NO: 100093 - DNA, 20 bp, Artificial Sequence
  Synthetic
cacggugaacacactcucgt

SEQ ID NO: 100094 - DNA, 27 bp, Artificial Sequence
  Synthetic
cagtatttcugagatgccauaagagca

SEQ ID NO: 100095 - DNA, 28 bp, Artificial Sequence
  Synthetic
ctggacagttautcgtgtctctuacaat

SEQ ID NO: 100096 - DNA, 22 bp, Artificial Sequence
  Synthetic
ccctucacaaggaggagtcuca

SEQ ID NO: 100097 - DNA, 18 bp, Artificial Sequence
  Synthetic
gaacauccgccugcgaga

SEQ ID NO: 100098 - DNA, 20 bp, Artificial Sequence
  Synthetic
gtcttctccugagccagguc

SEQ ID NO: 100099 - DNA, 23 bp, Artificial Sequence
  Synthetic
acttcccucacccatctctaugt

SEQ ID NO: 100100 - DNA, 24 bp, Artificial Sequence
  Synthetic
gctcaaaagcuctctgttcttugg

SEQ ID NO: 100101 - DNA, 28 bp, Artificial Sequence
  Synthetic
cttctgcagtacuctattcaaacagcua

SEQ ID NO: 100102 - DNA, 28 bp, Artificial Sequence
  Synthetic
atcaccagagguttttcatatcgaaugt

SEQ ID NO: 100103 - DNA, 28 bp, Artificial Sequence
  Synthetic
gagaacagguaaccagtttaatcaccua

SEQ ID NO: 100104 - DNA, 22 bp, Artificial Sequence
  Synthetic
ttgatgtcuttgcctaugcaca

SEQ ID NO: 100105 - DNA, 25 bp, Artificial Sequence
  Synthetic
gctctgataugccccatcttcaaut

SEQ ID NO: 100106 - DNA, 26 bp, Artificial Sequence
  Synthetic
ttttcgtaatguccttagagctgguc

SEQ ID NO: 100107 - DNA, 24 bp, Artificial Sequence
  Synthetic
ttccacagutctctgaaugccaat

SEQ ID NO: 100108 - DNA, 28 bp, Artificial Sequence
  Synthetic
cttcgaatggtuttaaatgtgatggugt

SEQ ID NO: 100109 - DNA, 27 bp, Artificial Sequence
  Synthetic
tcttgaaaccaacaguaagtcatcugt

SEQ ID NO: 100110 - DNA, 22 bp, Artificial Sequence
  Synthetic
gtattccugacggttcatugcc

SEQ ID NO: 100111 - DNA, 23 bp, Artificial Sequence
  Synthetic
gcacattcuctgggaacuaagga

SEQ ID NO: 100112 - DNA, 25 bp, Artificial Sequence
  Synthetic
gtgagtaggagugtgtgcatatcut

SEQ ID NO: 100113 - DNA, 27 bp, Artificial Sequence
  Synthetic
attcactctttgautgcagagttcuca

SEQ ID NO: 100114 - DNA, 23 bp, Artificial Sequence
  Synthetic
gtcccatcucgcacaaataguga

SEQ ID NO: 100115 - DNA, 29 bp, Artificial Sequence
  Synthetic
tctgacagatutgttattgaaguggacat

SEQ ID NO: 100116 - DNA, 28 bp, Artificial Sequence
  Synthetic
aggtgatagcutttcttcaattctucca

SEQ ID NO: 100117 - DNA, 26 bp, Artificial Sequence
  Synthetic
tgggcacctacuctacaattctgaua

SEQ ID NO: 100118 - DNA, 24 bp, Artificial Sequence
  Synthetic
attggcatucagagaactguggaa

SEQ ID NO: 100119 - DNA, 28 bp, Artificial Sequence
  Synthetic
acaagtatttugaagaccatcaagucca

SEQ ID NO: 100120 - DNA, 28 bp, Artificial Sequence
  Synthetic
tttattcctguaggtgtgaaauccagac

SEQ ID NO: 100121 - DNA, 25 bp, Artificial Sequence
  Synthetic
gccaccagcutctgtaaacttgaua

SEQ ID NO: 100122 - DNA, 24 bp, Artificial Sequence
  Synthetic
tcagcacagcacauctgaattuct

SEQ ID NO: 100123 - DNA, 28 bp, Artificial Sequence
  Synthetic
gcagattcttcuaaaccaacaaguacca

SEQ ID NO: 100124 - DNA, 24 bp, Artificial Sequence
  Synthetic
cccacattcgaugacctctgttut

SEQ ID NO: 100125 - DNA, 27 bp, Artificial Sequence
  Synthetic
gataccaccatutcactatcacagugt

SEQ ID NO: 100126 - DNA, 26 bp, Artificial Sequence
  Synthetic
agttcaaactucttgggctuagaaca

SEQ ID NO: 100127 - DNA, 26 bp, Artificial Sequence
  Synthetic
attgaagatgccautgaaagcaacuc

SEQ ID NO: 100128 - DNA, 23 bp, Artificial Sequence
  Synthetic
ctcgaatgcacutctttgctugt

SEQ ID NO: 100129 - DNA, 23 bp, Artificial Sequence
  Synthetic
tuggagucaaagacaaaccccat

SEQ ID NO: 100130 - DNA, 20 bp, Artificial Sequence
  Synthetic
cctgggagccutttcuggac

SEQ ID NO: 100131 - DNA, 28 bp, Artificial Sequence
  Synthetic
gattgtgagccacautaagttcttucaa

SEQ ID NO: 100132 - DNA, 29 bp, Artificial Sequence
  Synthetic
cagcctggatgaugatacagatgaauaat

SEQ ID NO: 100133 - DNA, 22 bp, Artificial Sequence
  Synthetic
ctatcgagguggcaaagtguca

SEQ ID NO: 100134 - DNA, 27 bp, Artificial Sequence
  Synthetic
aagccttcttguttccaattccuaaga

SEQ ID NO: 100135 - DNA, 25 bp, Artificial Sequence
  Synthetic
cggaatatccugaaagggcagaaua

SEQ ID NO: 100136 - DNA, 23 bp, Artificial Sequence
  Synthetic
gagctttgcutccttggugaaaa

SEQ ID NO: 100137 - DNA, 27 bp, Artificial Sequence
  Synthetic
caaagaacagagagcutttgagctuaa

SEQ ID NO: 100138 - DNA, 27 bp, Artificial Sequence
  Synthetic
caggatatuccggaccacattttcuat

SEQ ID NO: 100139 - DNA, 23 bp, Artificial Sequence
  Synthetic
tgccgtaauacagcaactctcuc

SEQ ID NO: 100140 - DNA, 26 bp, Artificial Sequence
  Synthetic
ccttgacauttctcatacucacacca

SEQ ID NO: 100141 - DNA, 23 bp, Artificial Sequence
  Synthetic
gaggtccaggaaggucaagttuc

SEQ ID NO: 100142 - DNA, 24 bp, Artificial Sequence
  Synthetic
ttccccautggacatcucaaaact

SEQ ID NO: 100143 - DNA, 28 bp, Artificial Sequence
  Synthetic
cgcaagtctgugcaataaatacttugaa

SEQ ID NO: 100144 - DNA, 22 bp, Artificial Sequence
  Synthetic
gcagtcgtgcuggtatcatcut

SEQ ID NO: 100145 - DNA, 21 bp, Artificial Sequence
  Synthetic
catccagcagggcutttcuga

SEQ ID NO: 100146 - DNA, 25 bp, Artificial Sequence
  Synthetic
gtgactttgaugccaacaatttucc

SEQ ID NO: 100147 - DNA, 27 bp, Artificial Sequence
  Synthetic
gaattcaaagccutcacaaauacagca

SEQ ID NO: 100148 - DNA, 22 bp, Artificial Sequence
  Synthetic
tuggaccttuccagcaacaaga

SEQ ID NO: 100149 - DNA, 26 bp, Artificial Sequence
  Synthetic
gcacctggtuggataaagttcauagg

SEQ ID NO: 100150 - DNA, 25 bp, Artificial Sequence
  Synthetic
tctctcttuagacctgtcccugaac

SEQ ID NO: 100151 - DNA, 22 bp, Artificial Sequence
  Synthetic
ccagaaccaaacgauggactuc

SEQ ID NO: 100152 - DNA, 21 bp, Artificial Sequence
  Synthetic
ggcacaucttcuggagacgac

SEQ ID NO: 100153 - DNA, 23 bp, Artificial Sequence
  Synthetic
gcaagaaatgccucaggaggtut

SEQ ID NO: 100154 - DNA, 26 bp, Artificial Sequence
  Synthetic
ccttccagataucttcacagagcuga

SEQ ID NO: 100155 - DNA, 28 bp, Artificial Sequence
  Synthetic
ggagttcagacacutataaggaaacgua

SEQ ID NO: 100156 - DNA, 25 bp, Artificial Sequence
  Synthetic
gccacaacaacutcttttcatugga

SEQ ID NO: 100157 - DNA, 29 bp, Artificial Sequence
  Synthetic
aagtacaagcaaagucattctgaguaaga

SEQ ID NO: 100158 - DNA, 17 bp, Artificial Sequence
  Synthetic
ggcctuggctgcaacuc

SEQ ID NO: 100159 - DNA, 25 bp, Artificial Sequence
  Synthetic
tgaaaccagcuatgtgaaagtccut

SEQ ID NO: 100160 - DNA, 21 bp, Artificial Sequence
  Synthetic
agcaggccaucauaggagaga

SEQ ID NO: 100161 - DNA, 25 bp, Artificial Sequence
  Synthetic
acaagcactgtuttcctgagatcut

SEQ ID NO: 100162 - DNA, 25 bp, Artificial Sequence
  Synthetic
ctcttgcacugaccttgatcacaua

SEQ ID NO: 100163 - DNA, 22 bp, Artificial Sequence
  Synthetic
ggaagctgcucacccaagatut

SEQ ID NO: 100164 - DNA, 24 bp, Artificial Sequence
  Synthetic
cagtactgucacctactcaugcac

SEQ ID NO: 100165 - DNA, 25 bp, Artificial Sequence
  Synthetic
gtttgttgctguttgtccaatcuga

SEQ ID NO: 100166 - DNA, 21 bp, Artificial Sequence
  Synthetic
ctgcaaggacucagaggctut

SEQ ID NO: 100167 - DNA, 23 bp, Artificial Sequence
  Synthetic
tccttgtuccgagcagtaaucac

SEQ ID NO: 100168 - DNA, 19 bp, Artificial Sequence
  Synthetic
tgccgguactccagguact

SEQ ID NO: 100169 - DNA, 28 bp, Artificial Sequence
  Synthetic
gataattgtccuggtcatgattgcaaug

SEQ ID NO: 100170 - DNA, 28 bp, Artificial Sequence
  Synthetic
ggtccctcgtaucaaaacattaagagua

SEQ ID NO: 100171 - DNA, 22 bp, Artificial Sequence
  Synthetic
agacucctttcugagacaggca

SEQ ID NO: 100172 - DNA, 27 bp, Artificial Sequence
  Synthetic
tcctgtgaacuctacagaatgtcuaca

SEQ ID NO: 100173 - DNA, 26 bp, Artificial Sequence
  Synthetic
cctagtttccagutatccagcaucag

SEQ ID NO: 100174 - DNA, 22 bp, Artificial Sequence
  Synthetic
caugacaaaggcctgugaagga

SEQ ID NO: 100175 - DNA, 23 bp, Artificial Sequence
  Synthetic
caaatccaacutgactggtgugg

SEQ ID NO: 100176 - DNA, 22 bp, Artificial Sequence
  Synthetic
ccaaccaaaucagccacctuct

SEQ ID NO: 100177 - DNA, 25 bp, Artificial Sequence
  Synthetic
ctttcccacuaccatcaactucact

SEQ ID NO: 100178 - DNA, 20 bp, Artificial Sequence
  Synthetic
ggccugggaggacgattuat

SEQ ID NO: 100179 - DNA, 28 bp, Artificial Sequence
  Synthetic
gctcctttaatgacuggttcctcattut

SEQ ID NO: 100180 - DNA, 22 bp, Artificial Sequence
  Synthetic
actgguaacagcttttguggga

SEQ ID NO: 100181 - DNA, 28 bp, Artificial Sequence
  Synthetic
attgtgatagaaaugtcactgagtgugt

SEQ ID NO: 100182 - DNA, 24 bp, Artificial Sequence
  Synthetic
ttcccaacugtccattttuggaaa

SEQ ID NO: 100183 - DNA, 19 bp, Artificial Sequence
  Synthetic
caagctgcucaggcugaac

SEQ ID NO: 100184 - DNA, 22 bp, Artificial Sequence
  Synthetic
cagauttcctccucaggagcat

SEQ ID NO: 100185 - DNA, 23 bp, Artificial Sequence
  Synthetic
cctatgtcctugtcacctgccua

SEQ ID NO: 100186 - DNA, 23 bp, Artificial Sequence
  Synthetic
tgtactggccauctagtgtucca

SEQ ID NO: 100187 - DNA, 24 bp, Artificial Sequence
  Synthetic
tcatcatugcgacctucaggaaaa

SEQ ID NO: 100188 - DNA, 19 bp, Artificial Sequence
  Synthetic
ctcactgggutgcctcugt

SEQ ID NO: 100189 - DNA, 20 bp, Artificial Sequence
  Synthetic
cctcctccuctcctctgguc

SEQ ID NO: 100190 - DNA, 21 bp, Artificial Sequence
  Synthetic
ggatctgtugacccagcagug

SEQ ID NO: 100191 - DNA, 23 bp, Artificial Sequence
  Synthetic
atgtctctugagcagaggaguct

SEQ ID NO: 100192 - DNA, 23 bp, Artificial Sequence
  Synthetic
caaugtcacacaaugccacacat

SEQ ID NO: 100193 - DNA, 21 bp, Artificial Sequence
  Synthetic
cutcactgtctaugccaccca

SEQ ID NO: 100194 - DNA, 21 bp, Artificial Sequence
  Synthetic
tcacctgguagcccagaugat

SEQ ID NO: 100195 - DNA, 20 bp, Artificial Sequence
  Synthetic
ggtggagcugtacugcaaca

SEQ ID NO: 100196 - DNA, 27 bp, Artificial Sequence
  Synthetic
cccatcugaaccatcaaaaatguagag

SEQ ID NO: 100197 - DNA, 20 bp, Artificial Sequence
  Synthetic
ctgttacgcgguctctcugg

SEQ ID NO: 100198 - DNA, 28 bp, Artificial Sequence
  Synthetic
agtgagttgtagutaagggtaggaucag

SEQ ID NO: 100199 - DNA, 21 bp, Artificial Sequence
  Synthetic
ccctctcucatcagcugggat

SEQ ID NO: 100200 - DNA, 20 bp, Artificial Sequence
  Synthetic
ttggcaagagutcggctuct

SEQ ID NO: 100201 - DNA, 29 bp, Artificial Sequence
  Synthetic
tggctttctctcauttgttatgtgtttug

SEQ ID NO: 100202 - DNA, 22 bp, Artificial Sequence
  Synthetic
gtctggaaguctgcgttgaaug

SEQ ID NO: 100203 - DNA, 22 bp, Artificial Sequence
  Synthetic
cttgtggaggccucatgactut

SEQ ID NO: 100204 - DNA, 20 bp, Artificial Sequence
  Synthetic
ccatacaagguggctgggua

SEQ ID NO: 100205 - DNA, 27 bp, Artificial Sequence
  Synthetic
ctgtcucaagagaagaccaatgtucat

SEQ ID NO: 100206 - DNA, 22 bp, Artificial Sequence
  Synthetic
cugtaaaagtcuaccccaggct

SEQ ID NO: 100207 - DNA, 20 bp, Artificial Sequence
  Synthetic
gcaucagccgcaaagagcua

SEQ ID NO: 100208 - DNA, 27 bp, Artificial Sequence
  Synthetic
ccttctggtattuctgccaccattuat

SEQ ID NO: 100209 - DNA, 20 bp, Artificial Sequence
  Synthetic
cttcccgaaugtgtgtugcc

SEQ ID NO: 100210 - DNA, 27 bp, Artificial Sequence
  Synthetic
tctaattgaacugcagacatggtugaa

SEQ ID NO: 100211 - DNA, 33 bp, Artificial Sequence
  Synthetic
gttttgagttagucaatcttagaaatgaauacc

SEQ ID NO: 100212 - DNA, 22 bp, Artificial Sequence
  Synthetic
catactccatcugcagggctuc

SEQ ID NO: 100213 - DNA, 22 bp, Artificial Sequence
  Synthetic
gaactgacgtuggcaggaagua

SEQ ID NO: 100214 - DNA, 27 bp, Artificial Sequence
  Synthetic
acaatggucagaaagacaatgccttua

SEQ ID NO: 100215 - DNA, 24 bp, Artificial Sequence
  Synthetic
tgaagtgtgcuaatggagauccac

SEQ ID NO: 100216 - DNA, 18 bp, Artificial Sequence
  Synthetic
cgacuccccctctcguct

SEQ ID NO: 100217 - DNA, 17 bp, Artificial Sequence
  Synthetic
gtgagcgcgucgttgug

SEQ ID NO: 100218 - DNA, 22 bp, Artificial Sequence
  Synthetic
cttgtcgggcutggtgaaaaug

SEQ ID NO: 100219 - DNA, 21 bp, Artificial Sequence
  Synthetic
cgtgctcuagggacacctaug

SEQ ID NO: 100220 - DNA, 24 bp, Artificial Sequence
  Synthetic
ctcctttcacuctgtgtccucaaa

SEQ ID NO: 100221 - DNA, 25 bp, Artificial Sequence
  Synthetic
tcaagcatgaautcagtccugacaa

SEQ ID NO: 100222 - DNA, 25 bp, Artificial Sequence
  Synthetic
acgaatgtuagagactgcuccaaag

SEQ ID NO: 100223 - DNA, 22 bp, Artificial Sequence
  Synthetic
tggaggccaugctttaugcaat

SEQ ID NO: 100224 - DNA, 24 bp, Artificial Sequence
  Synthetic
tcagggtccutgttaatctgguca

SEQ ID NO: 100225 - DNA, 22 bp, Artificial Sequence
  Synthetic
ccaggagtaugcccattccaua

SEQ ID NO: 100226 - DNA, 20 bp, Artificial Sequence
  Synthetic
tcgagguggagacccatgut

SEQ ID NO: 100227 - DNA, 25 bp, Artificial Sequence
  Synthetic
agacctgugtgtctgatuagagagg

SEQ ID NO: 100228 - DNA, 18 bp, Artificial Sequence
  Synthetic
guggaaccagagcccuca

SEQ ID NO: 100229 - DNA, 19 bp, Artificial Sequence
  Synthetic
gggaagtgcucctggacut

SEQ ID NO: 100230 - DNA, 20 bp, Artificial Sequence
  Synthetic
cagccgaacuccgacacaua

SEQ ID NO: 100231 - DNA, 24 bp, Artificial Sequence
  Synthetic
cctcccucttcttttucccaacag

SEQ ID NO: 100232 - DNA, 25 bp, Artificial Sequence
  Synthetic
gaactaccaaucatcaauccaggct

SEQ ID NO: 100233 - DNA, 22 bp, Artificial Sequence
  Synthetic
tgactagtugaagggcctugac

SEQ ID NO: 100234 - DNA, 20 bp, Artificial Sequence
  Synthetic
gagaaggaccuggtguggaa

SEQ ID NO: 100235 - DNA, 19 bp, Artificial Sequence
  Synthetic
gtagccagaggcugtgguc

SEQ ID NO: 100236 - DNA, 21 bp, Artificial Sequence
  Synthetic
ccttcugcaaaggcucagact

SEQ ID NO: 100237 - DNA, 22 bp, Artificial Sequence
  Synthetic
gaggccucctacaucaggaaac

SEQ ID NO: 100238 - DNA, 21 bp, Artificial Sequence
  Synthetic
caaagaaccucacagggccut

SEQ ID NO: 100239 - DNA, 28 bp, Artificial Sequence
  Synthetic
cagttattggccautacactcugaaaat

SEQ ID NO: 100240 - DNA, 23 bp, Artificial Sequence
  Synthetic
ccccaaaauaatgtccccaucca

SEQ ID NO: 100241 - DNA, 23 bp, Artificial Sequence
  Synthetic
ggattgcaauaccacctguggag

SEQ ID NO: 100242 - DNA, 23 bp, Artificial Sequence
  Synthetic
cccctacucacgttgatgaucac

SEQ ID NO: 100243 - DNA, 20 bp, Artificial Sequence
  Synthetic
gcctcgugaatgacccaucc

SEQ ID NO: 100244 - DNA, 24 bp, Artificial Sequence
  Synthetic
ggucaggaaaagaagcucaaacag

SEQ ID NO: 100245 - DNA, 21 bp, Artificial Sequence
  Synthetic
cgtggtuggaatgcttcauca

SEQ ID NO: 100246 - DNA, 28 bp, Artificial Sequence
  Synthetic
tctgttccattugtgacattgtaugact

SEQ ID NO: 100247 - DNA, 27 bp, Artificial Sequence
  Synthetic
tttctagctcaguggtaagcttaggua

SEQ ID NO: 100248 - DNA, 19 bp, Artificial Sequence
  Synthetic
ttcccagcggguaagucac

SEQ ID NO: 100249 - DNA, 22 bp, Artificial Sequence
  Synthetic
aatgtcuggagcgcttctgaut

SEQ ID NO: 100250 - DNA, 28 bp, Artificial Sequence
  Synthetic
agaggcaataattuccaaagcagatcut

SEQ ID NO: 100251 - DNA, 22 bp, Artificial Sequence
  Synthetic
cttaacgcgauctgctctgtug

SEQ ID NO: 100252 - DNA, 25 bp, Artificial Sequence
  Synthetic
agctgaggtaacucattttgccaut

SEQ ID NO: 100253 - DNA, 21 bp, Artificial Sequence
  Synthetic
accacaacgcuctgattcucc

SEQ ID NO: 100254 - DNA, 23 bp, Artificial Sequence
  Synthetic
catcttcagtguctgggatcgug

SEQ ID NO: 100255 - DNA, 26 bp, Artificial Sequence
  Synthetic
atttcttaggtaugcctggactgtug

SEQ ID NO: 100256 - DNA, 23 bp, Artificial Sequence
  Synthetic
gagagagtuggagtcaatgguga

SEQ ID NO: 100257 - DNA, 27 bp, Artificial Sequence
  Synthetic
cccctggaatcauataccatacaggut

SEQ ID NO: 100258 - DNA, 22 bp, Artificial Sequence
  Synthetic
gcttgcacagaucttacacugg

SEQ ID NO: 100259 - DNA, 28 bp, Artificial Sequence
  Synthetic
cctctaaagtctgucttcatgataggut

SEQ ID NO: 100260 - DNA, 22 bp, Artificial Sequence
  Synthetic
ggcagtcccaaugttggatgut

SEQ ID NO: 100261 - DNA, 20 bp, Artificial Sequence
  Synthetic
gtgacccccggutatcctug

SEQ ID NO: 100262 - DNA, 23 bp, Artificial Sequence
  Synthetic
aattgaacccutacacccuacgg

SEQ ID NO: 100263 - DNA, 28 bp, Artificial Sequence
  Synthetic
agtagcctcatugtcatcatcctcauat

SEQ ID NO: 100264 - DNA, 22 bp, Artificial Sequence
  Synthetic
ccauggaattcuggaccaagga

SEQ ID NO: 100265 - DNA, 20 bp, Artificial Sequence
  Synthetic
caaggtcugaggaccggaug

SEQ ID NO: 100266 - DNA, 23 bp, Artificial Sequence
  Synthetic
ccaagacgacauagccaggagua

SEQ ID NO: 100267 - DNA, 24 bp, Artificial Sequence
  Synthetic
tcaaggagaucaaaggcuacaagg

SEQ ID NO: 100268 - DNA, 21 bp, Artificial Sequence
  Synthetic
cagccacagugacgaagaugt

SEQ ID NO: 100269 - DNA, 23 bp, Artificial Sequence
  Synthetic
tcacaggcugtttctgacttuca

SEQ ID NO: 100270 - DNA, 27 bp, Artificial Sequence
  Synthetic
tggaattctgtaugtggtcaaatcugt

SEQ ID NO: 100271 - DNA, 25 bp, Artificial Sequence
  Synthetic
acagctgcaaugtactggtaugaat

SEQ ID NO: 100272 - DNA, 20 bp, Artificial Sequence
  Synthetic
tggacaccgcugtgattugt

SEQ ID NO: 100273 - DNA, 24 bp, Artificial Sequence
  Synthetic
cagttcacttuggttttccagcuc

SEQ ID NO: 100274 - DNA, 24 bp, Artificial Sequence
  Synthetic
gtttggtggaugtaccctttccua

SEQ ID NO: 100275 - DNA, 27 bp, Artificial Sequence
  Synthetic
caaagaguaccacaaaaggttgaacut

SEQ ID NO: 100276 - DNA, 21 bp, Artificial Sequence
  Synthetic
gtttaacgaagcccuccguga

SEQ ID NO: 100277 - DNA, 21 bp, Artificial Sequence
  Synthetic
cagccccuttaggaccaaugt

SEQ ID NO: 100278 - DNA, 20 bp, Artificial Sequence
  Synthetic
cgccatuaaccgccagatut

SEQ ID NO: 100279 - DNA, 25 bp, Artificial Sequence
  Synthetic
aagaagggccagutcttgaatguag

SEQ ID NO: 100280 - DNA, 19 bp, Artificial Sequence
  Synthetic
cucaaggaccaccgcauct

SEQ ID NO: 100281 - DNA, 18 bp, Artificial Sequence
  Synthetic
gtcacaguggcctcgcua

SEQ ID NO: 100282 - DNA, 28 bp, Artificial Sequence
  Synthetic
ctcagucagaagaaaauggacaaaaacc

SEQ ID NO: 100283 - DNA, 22 bp, Artificial Sequence
  Synthetic
atgacccctuacacaacgtcuc

SEQ ID NO: 100284 - DNA, 25 bp, Artificial Sequence
  Synthetic
gcactgtgaaacucattcagguaga

SEQ ID NO: 100285 - DNA, 21 bp, Artificial Sequence
  Synthetic
gctcguggacaagattgtgug

SEQ ID NO: 100286 - DNA, 31 bp, Artificial Sequence
  Synthetic
cactgtcactcauttttattttatactgcut

SEQ ID NO: 100287 - DNA, 22 bp, Artificial Sequence
  Synthetic
tgaugcacccaacugaccaaat

SEQ ID NO: 100288 - DNA, 27 bp, Artificial Sequence
  Synthetic
gtcattgcatuttgttttcagtugaca

SEQ ID NO: 100289 - DNA, 28 bp, Artificial Sequence
  Synthetic
tgaccaaactgaagugctatcatacaut

SEQ ID NO: 100290 - DNA, 20 bp, Artificial Sequence
  Synthetic
gctgagugccctctgtcaut

SEQ ID NO: 100291 - DNA, 28 bp, Artificial Sequence
  Synthetic
tccagtactttcaautcatggagcauac

SEQ ID NO: 100292 - DNA, 22 bp, Artificial Sequence
  Synthetic
catggcagcuagtcatttgugg

SEQ ID NO: 100293 - DNA, 28 bp, Artificial Sequence
  Synthetic
ttcacttacttugcaatcttctcctuga

SEQ ID NO: 100294 - DNA, 20 bp, Artificial Sequence
  Synthetic
ctcctuaccagggtcccgua

SEQ ID NO: 100295 - DNA, 25 bp, Artificial Sequence
  Synthetic
gatggatgtguactgcttcctctuc

SEQ ID NO: 100296 - DNA, 20 bp, Artificial Sequence
  Synthetic
gucaccaacagcagauccgt

SEQ ID NO: 100297 - DNA, 24 bp, Artificial Sequence
  Synthetic
ggugggaggagtgttugacaaaaa

SEQ ID NO: 100298 - DNA, 20 bp, Artificial Sequence
  Synthetic
ctgaaguctggugagcccaa

SEQ ID NO: 100299 - DNA, 20 bp, Artificial Sequence
  Synthetic
gcctccucgttgctguacat

SEQ ID NO: 100300 - DNA, 27 bp, Artificial Sequence
  Synthetic
gatactgaatgguaaggtcagatcugg

SEQ ID NO: 100301 - DNA, 25 bp, Artificial Sequence
  Synthetic
ttgcttcaggucatcaggaattuct

SEQ ID NO: 100302 - DNA, 24 bp, Artificial Sequence
  Synthetic
tggaagggauccagttacttguct

SEQ ID NO: 100303 - DNA, 25 bp, Artificial Sequence
  Synthetic
ggcttagcttcutgattgcaacaut

SEQ ID NO: 100304 - DNA, 21 bp, Artificial Sequence
  Synthetic
caagaugaagcccctguggat

SEQ ID NO: 100305 - DNA, 21 bp, Artificial Sequence
  Synthetic
gtcttcuccacccccactcua

SEQ ID NO: 100306 - DNA, 21 bp, Artificial Sequence
  Synthetic
ggagtggacugccgcttuaat

SEQ ID NO: 100307 - DNA, 27 bp, Artificial Sequence
  Synthetic
ccaagggttaatucttcaaactgctuc

SEQ ID NO: 100308 - DNA, 24 bp, Artificial Sequence
  Synthetic
agactgtgguggttacccatauga

SEQ ID NO: 100309 - DNA, 24 bp, Artificial Sequence
  Synthetic
gtgaagctguccatctccuacaaa

SEQ ID NO: 100310 - DNA, 26 bp, Artificial Sequence
  Synthetic
cagcttatgaugccattctugaaaga

SEQ ID NO: 100311 - DNA, 32 bp, Artificial Sequence
  Synthetic
atgttcacttacatutttgtgattaacacaut

SEQ ID NO: 100312 - DNA, 25 bp, Artificial Sequence
  Synthetic
ccgaccattucagaatcagacucat

SEQ ID NO: 100313 - DNA, 32 bp, Artificial Sequence
  Synthetic
aaatcttgattucatctatactuaggaaacca

SEQ ID NO: 100314 - DNA, 26 bp, Artificial Sequence
  Synthetic
tgggttttccutctttagagcauacc

SEQ ID NO: 100315 - DNA, 22 bp, Artificial Sequence
  Synthetic
tttgccauagttaggcucagca

SEQ ID NO: 100316 - DNA, 28 bp, Artificial Sequence
  Synthetic
gcatcaccatgaugaagagtttattgut

SEQ ID NO: 100317 - DNA, 26 bp, Artificial Sequence
  Synthetic
cttgacccttcauggtttcatttguc

SEQ ID NO: 100318 - DNA, 22 bp, Artificial Sequence
  Synthetic
gttgcgctutcctttctgucaa

SEQ ID NO: 100319 - DNA, 25 bp, Artificial Sequence
  Synthetic
acagggttugagcagttcttatucc

SEQ ID NO: 100320 - DNA, 23 bp, Artificial Sequence
  Synthetic
gtccaccaggcutgagtaaagua

SEQ ID NO: 100321 - DNA, 24 bp, Artificial Sequence
  Synthetic
cgtcactaucttttcaccauggca

SEQ ID NO: 100322 - DNA, 26 bp, Artificial Sequence
  Synthetic
caaagccaauctttgaacauccacat

SEQ ID NO: 100323 - DNA, 28 bp, Artificial Sequence
  Synthetic
ccaaaatatcucaagctggcaatuaagt

SEQ ID NO: 100324 - DNA, 21 bp, Artificial Sequence
  Synthetic
cccactcacuactctgcacuc

SEQ ID NO: 100325 - DNA, 21 bp, Artificial Sequence
  Synthetic
actgactugggccttcccuaa

SEQ ID NO: 100326 - DNA, 24 bp, Artificial Sequence
  Synthetic
tcaaaaautccgcugcaagaagac

SEQ ID NO: 100327 - DNA, 22 bp, Artificial Sequence
  Synthetic
gattguacccggacaggatuct

SEQ ID NO: 100328 - DNA, 23 bp, Artificial Sequence
  Synthetic
acgtgtugagcagttttcuccat

SEQ ID NO: 100329 - DNA, 25 bp, Artificial Sequence
  Synthetic
tgctgtccttuaattgcagcaaauc

SEQ ID NO: 100330 - DNA, 20 bp, Artificial Sequence
  Synthetic
cagcacaagggaccucctua

SEQ ID NO: 100331 - DNA, 27 bp, Artificial Sequence
  Synthetic
gtggaaggugacatcaagttcauaact

SEQ ID NO: 100332 - DNA, 22 bp, Artificial Sequence
  Synthetic
gctctaucacccaccacccuat

SEQ ID NO: 100333 - DNA, 20 bp, Artificial Sequence
  Synthetic
tcaaagtgguccgacgacug

SEQ ID NO: 100334 - DNA, 21 bp, Artificial Sequence
  Synthetic
aaacaagcuggctctcauggt

SEQ ID NO: 100335 - DNA, 24 bp, Artificial Sequence
  Synthetic
acggaggtcuacggagacatuaaa

SEQ ID NO: 100336 - DNA, 22 bp, Artificial Sequence
  Synthetic
catactgctccugccacttcuc

SEQ ID NO: 100337 - DNA, 21 bp, Artificial Sequence
  Synthetic
gaacagcccuaacagcctcuc

SEQ ID NO: 100338 - DNA, 22 bp, Artificial Sequence
  Synthetic
gctctgttucaatcagggugac

SEQ ID NO: 100339 - DNA, 21 bp, Artificial Sequence
  Synthetic
gatgagacagcugcucacact

SEQ ID NO: 100340 - DNA, 21 bp, Artificial Sequence
  Synthetic
ctctagagcccugctgactua

SEQ ID NO: 100341 - DNA, 22 bp, Artificial Sequence
  Synthetic
tccccugaaaagctacagcauc

SEQ ID NO: 100342 - DNA, 22 bp, Artificial Sequence
  Synthetic
ctttgctgagugcctggaagua

SEQ ID NO: 100343 - DNA, 22 bp, Artificial Sequence
  Synthetic
tccagccucgattctcuacact

SEQ ID NO: 100344 - DNA, 21 bp, Artificial Sequence
  Synthetic
gcutcaacucagcagcaaagt

SEQ ID NO: 100345 - DNA, 23 bp, Artificial Sequence
  Synthetic
accatctgugtctcctcttucct

SEQ ID NO: 100346 - DNA, 22 bp, Artificial Sequence
  Synthetic
ctcttttccccugcatccucaa

SEQ ID NO: 100347 - DNA, 27 bp, Artificial Sequence
  Synthetic
ctctaaccactcugtccttgcttttua

SEQ ID NO: 100348 - DNA, 23 bp, Artificial Sequence
  Synthetic
gtccataucaggcaagcauccat

SEQ ID NO: 100349 - DNA, 28 bp, Artificial Sequence
  Synthetic
caatgatgaaggcutctcttctagtuct

SEQ ID NO: 100350 - DNA, 21 bp, Artificial Sequence
  Synthetic
actgaatccgutgacgtccug

SEQ ID NO: 100351 - DNA, 20 bp, Artificial Sequence
  Synthetic
ccctugcacatgucccaaag

SEQ ID NO: 100352 - DNA, 27 bp, Artificial Sequence
  Synthetic
ctttcttgtttugagttactgtugcct

SEQ ID NO: 100353 - DNA, 27 bp, Artificial Sequence
  Synthetic
attggcatcucatttttgttgtucaca

SEQ ID NO: 100354 - DNA, 23 bp, Artificial Sequence
  Synthetic
cccccaugattcacgguaaaaac

SEQ ID NO: 100355 - DNA, 23 bp, Artificial Sequence
  Synthetic
ttcaccugggagcagatuaacac

SEQ ID NO: 100356 - DNA, 21 bp, Artificial Sequence
  Synthetic
tccagcautggtttcucccat

SEQ ID NO: 100357 - DNA, 28 bp, Artificial Sequence
  Synthetic
cacgggaatgtauttacccatatctcut

SEQ ID NO: 100358 - DNA, 27 bp, Artificial Sequence
  Synthetic
ttccgtggcagaaautctaaagtuact

SEQ ID NO: 100359 - DNA, 28 bp, Artificial Sequence
  Synthetic
aacaactctatautgctggaacauggaa

SEQ ID NO: 100360 - DNA, 27 bp, Artificial Sequence
  Synthetic
tggtgaatgatucaacaaactggguaa

SEQ ID NO: 100361 - DNA, 22 bp, Artificial Sequence
  Synthetic
ctatcactggcauccccttcug

SEQ ID NO: 100362 - DNA, 25 bp, Artificial Sequence
  Synthetic
ggtcatgaauttgaaaggtgucagg

SEQ ID NO: 100363 - DNA, 27 bp, Artificial Sequence
  Synthetic
tgagtggctaucacttcaaacugaaat

SEQ ID NO: 100364 - DNA, 28 bp, Artificial Sequence
  Synthetic
tgtttgttgaaaaguagttctgggucaa

SEQ ID NO: 100365 - DNA, 28 bp, Artificial Sequence
  Synthetic
cttgaaagcttgugatcagatgcaauaa

SEQ ID NO: 100366 - DNA, 28 bp, Artificial Sequence
  Synthetic
ggttggaguaacagatauaggaggagag

SEQ ID NO: 100367 - DNA, 25 bp, Artificial Sequence
  Synthetic
cacagtgctuttctcctgttaucca

SEQ ID NO: 100368 - DNA, 25 bp, Artificial Sequence
  Synthetic
agagaagaaaaacugcagacuccaa

SEQ ID NO: 100369 - DNA, 22 bp, Artificial Sequence
  Synthetic
cctgcactcuctgtttcctguc

SEQ ID NO: 100370 - DNA, 20 bp, Artificial Sequence
  Synthetic
gaggucagagcggaaacuct

SEQ ID NO: 100371 - DNA, 21 bp, Artificial Sequence
  Synthetic
ccucagacagcaaagccuacc

SEQ ID NO: 100372 - DNA, 20 bp, Artificial Sequence
  Synthetic
cgagagugcatcuccagcat

SEQ ID NO: 100373 - DNA, 22 bp, Artificial Sequence
  Synthetic
ctcactgucttctctgtuggca

SEQ ID NO: 100374 - DNA, 24 bp, Artificial Sequence
  Synthetic
gagaagcacaguaaacacgaguga

SEQ ID NO: 100375 - DNA, 21 bp, Artificial Sequence
  Synthetic
tcagcacttuctggccacaut

SEQ ID NO: 100376 - DNA, 27 bp, Artificial Sequence
  Synthetic
ccatggtaaaaugccatacctgauaga

SEQ ID NO: 100377 - DNA, 23 bp, Artificial Sequence
  Synthetic
cgtctacgugaaggtgaatggug

SEQ ID NO: 100378 - DNA, 21 bp, Artificial Sequence
  Synthetic
cattccacacagggutcccut

SEQ ID NO: 100379 - DNA, 22 bp, Artificial Sequence
  Synthetic
ccaacccugaaggagaaugaca

SEQ ID NO: 100380 - DNA, 26 bp, Artificial Sequence
  Synthetic
gaagtagtaauggaagtcgaugcagt

SEQ ID NO: 100381 - DNA, 22 bp, Artificial Sequence
  Synthetic
tgtctctactucccacctgcut

SEQ ID NO: 100382 - DNA, 28 bp, Artificial Sequence
  Synthetic
agtgaaaatgagaaacuaacagacacut

SEQ ID NO: 100383 - DNA, 27 bp, Artificial Sequence
  Synthetic
tccttcatctgacugcccatcaataua

SEQ ID NO: 100384 - DNA, 20 bp, Artificial Sequence
  Synthetic
ccgcaacaggaguacugact

SEQ ID NO: 100385 - DNA, 28 bp, Artificial Sequence
  Synthetic
ccacagtacuactaaaagaacgtucgac

SEQ ID NO: 100386 - DNA, 25 bp, Artificial Sequence
  Synthetic
cttctacagtucagtcgaacgtuct

SEQ ID NO: 100387 - DNA, 28 bp, Artificial Sequence
  Synthetic
cctttacttcatucagtgttccagaucc

SEQ ID NO: 100388 - DNA, 27 bp, Artificial Sequence
  Synthetic
ttgatggtgacugttttaatgagcuct

SEQ ID NO: 100389 - DNA, 25 bp, Artificial Sequence
  Synthetic
ggtggagaagugggttttcaaauca

SEQ ID NO: 100390 - DNA, 24 bp, Artificial Sequence
  Synthetic
gagactgaatugaggcagtgtuga

SEQ ID NO: 100391 - DNA, 24 bp, Artificial Sequence
  Synthetic
gccatctttggugaaaccatggua

SEQ ID NO: 100392 - DNA, 22 bp, Artificial Sequence
  Synthetic
aggagaatggugctccaactuc

SEQ ID NO: 100393 - DNA, 25 bp, Artificial Sequence
  Synthetic
ttgtatctctgucttcatcgcctuc

SEQ ID NO: 100394 - DNA, 24 bp, Artificial Sequence
  Synthetic
aggtgaaggaccuttgactuacct

SEQ ID NO: 100395 - DNA, 19 bp, Artificial Sequence
  Synthetic
gctccgccucttccactuc

SEQ ID NO: 100396 - DNA, 17 bp, Artificial Sequence
  Synthetic
gggaacgccguggucag

SEQ ID NO: 100397 - DNA, 18 bp, Artificial Sequence
  Synthetic
tgcgggaggutccucagt

SEQ ID NO: 100398 - DNA, 28 bp, Artificial Sequence
  Synthetic
aggctaaaaaccutagaaagacactugt

SEQ ID NO: 100399 - DNA, 25 bp, Artificial Sequence
  Synthetic
cagtgcactacauacttacccacut

SEQ ID NO: 100400 - DNA, 27 bp, Artificial Sequence
  Synthetic
ttattcacaacgutccaaaatccctug

SEQ ID NO: 100401 - DNA, 23 bp, Artificial Sequence
  Synthetic
ccctcccttucttcgtcttctug

SEQ ID NO: 100402 - DNA, 21 bp, Artificial Sequence
  Synthetic
ctacagguggccaactgtcut

SEQ ID NO: 100403 - DNA, 21 bp, Artificial Sequence
  Synthetic
gcttcautgccatugacacca

SEQ ID NO: 100404 - DNA, 20 bp, Artificial Sequence
  Synthetic
attcucggccatgucaagca

SEQ ID NO: 100405 - DNA, 21 bp, Artificial Sequence
  Synthetic
ggatagggcugaatgcuaggg

SEQ ID NO: 100406 - DNA, 21 bp, Artificial Sequence
  Synthetic
actcacuagggactggaucgt

SEQ ID NO: 100407 - DNA, 22 bp, Artificial Sequence
  Synthetic
cactcggatugccaccaaaaut

SEQ ID NO: 100408 - DNA, 28 bp, Artificial Sequence
  Synthetic
tcctttttcctutctagcagagauacct

SEQ ID NO: 100409 - DNA, 22 bp, Artificial Sequence
  Synthetic
ggaaagugttcaagcuccggaa

SEQ ID NO: 100410 - DNA, 21 bp, Artificial Sequence
  Synthetic
acaaagagguggtgggttuca

SEQ ID NO: 100411 - DNA, 27 bp, Artificial Sequence
  Synthetic
cttcctgagugaggcatttatttgtut

SEQ ID NO: 100412 - DNA, 26 bp, Artificial Sequence
  Synthetic
gaatatttgcccuagaatgccagcua

SEQ ID NO: 100413 - DNA, 24 bp, Artificial Sequence
  Synthetic
cccggaaccaugataagaaucgaa

SEQ ID NO: 100414 - DNA, 19 bp, Artificial Sequence
  Synthetic
agaggcagcacguccauac

SEQ ID NO: 100415 - DNA, 23 bp, Artificial Sequence
  Synthetic
gcagggccuatctattcacctut

SEQ ID NO: 100416 - DNA, 22 bp, Artificial Sequence
  Synthetic
gugcauaccaagggcacagaat

SEQ ID NO: 100417 - DNA, 25 bp, Artificial Sequence
  Synthetic
gcgtaacaacaaauccaacatggug

SEQ ID NO: 100418 - DNA, 28 bp, Artificial Sequence
  Synthetic
agttcttcaaatgautcatagggctuca

SEQ ID NO: 100419 - DNA, 21 bp, Artificial Sequence
  Synthetic
gtuccacccgcaguacagaaa

SEQ ID NO: 100420 - DNA, 23 bp, Artificial Sequence
  Synthetic
tggtcaauggaagcctgtgauac

SEQ ID NO: 100421 - DNA, 28 bp, Artificial Sequence
  Synthetic
ctaaggcaagcugaatacaaacaguaaa

SEQ ID NO: 100422 - DNA, 21 bp, Artificial Sequence
  Synthetic
tgggatacucaccagggtcuc

SEQ ID NO: 100423 - DNA, 24 bp, Artificial Sequence
  Synthetic
gctcacctctutgctctgtgttua

SEQ ID NO: 100424 - DNA, 23 bp, Artificial Sequence
  Synthetic
gguaaaccacagatctugagcct

SEQ ID NO: 100425 - DNA, 23 bp, Artificial Sequence
  Synthetic
tccccttgauttctgctctcuct

SEQ ID NO: 100426 - DNA, 26 bp, Artificial Sequence
  Synthetic
aataaaagccucataactgacugcca

SEQ ID NO: 100427 - DNA, 21 bp, Artificial Sequence
  Synthetic
tgcgactcutgctgtcuaacc

SEQ ID NO: 100428 - DNA, 20 bp, Artificial Sequence
  Synthetic
cagctccucgctctccatuc

SEQ ID NO: 100429 - DNA, 21 bp, Artificial Sequence
  Synthetic
ctacaaccucaccgtgcagua

SEQ ID NO: 100430 - DNA, 22 bp, Artificial Sequence
  Synthetic
ctgctggtugaacacatacugg

SEQ ID NO: 100431 - DNA, 24 bp, Artificial Sequence
  Synthetic
cttgtttctugcctgcatgtttug

SEQ ID NO: 100432 - DNA, 20 bp, Artificial Sequence
  Synthetic
ccccacaggcuggtctctua

SEQ ID NO: 100433 - DNA, 22 bp, Artificial Sequence
  Synthetic
acgatccagacucatcccuacc

SEQ ID NO: 100434 - DNA, 21 bp, Artificial Sequence
  Synthetic
gguagctcatcuccacagggt

SEQ ID NO: 100435 - DNA, 25 bp, Artificial Sequence
  Synthetic
gacaaagggcaaagcutctauaggt

SEQ ID NO: 100436 - DNA, 20 bp, Artificial Sequence
  Synthetic
ctgagtgugggcaactcucc

SEQ ID NO: 100437 - DNA, 27 bp, Artificial Sequence
  Synthetic
tcatgtgtgtttcuttctctccttcuc

SEQ ID NO: 100438 - DNA, 17 bp, Artificial Sequence
  Synthetic
ggcggugccaagaccuc

SEQ ID NO: 100439 - DNA, 17 bp, Artificial Sequence
  Synthetic
gcugcccagcacguagt

SEQ ID NO: 100440 - DNA, 21 bp, Artificial Sequence
  Synthetic
caagaaaugcggcaagcucaa

SEQ ID NO: 100441 - DNA, 19 bp, Artificial Sequence
  Synthetic
aacacgcacutgaccguct

SEQ ID NO: 100442 - DNA, 17 bp, Artificial Sequence
  Synthetic
cgggcgacgacuacgug

SEQ ID NO: 100443 - DNA, 19 bp, Artificial Sequence
  Synthetic
cgtccggcucctgttugat

SEQ ID NO: 100444 - DNA, 20 bp, Artificial Sequence
  Synthetic
tgccgaggacuttgcaacut

SEQ ID NO: 100445 - DNA, 20 bp, Artificial Sequence
  Synthetic
ctctccgcutccaagctcuc

SEQ ID NO: 100446 - DNA, 22 bp, Artificial Sequence
  Synthetic
cgugtttctggaugaggacgac

SEQ ID NO: 100447 - DNA, 17 bp, Artificial Sequence
  Synthetic
ggcacttuggcgacgut

SEQ ID NO: 100448 - DNA, 19 bp, Artificial Sequence
  Synthetic
gcagctgcugagacgcuac

SEQ ID NO: 100449 - DNA, 21 bp, Artificial Sequence
  Synthetic
gtgctgctuggtgatgttcut

SEQ ID NO: 100450 - DNA, 18 bp, Artificial Sequence
  Synthetic
ccugcagcggatcauggt

SEQ ID NO: 100451 - DNA, 18 bp, Artificial Sequence
  Synthetic
agtctgggucgctcucgt

SEQ ID NO: 100452 - DNA, 20 bp, Artificial Sequence
  Synthetic
gagggcgaautcatggctug

SEQ ID NO: 100453 - DNA, 22 bp, Artificial Sequence
  Synthetic
ccatgatcutcctgcgtucgat

SEQ ID NO: 100454 - DNA, 19 bp, Artificial Sequence
  Synthetic
gccgccuctactacagcut

SEQ ID NO: 100455 - DNA, 21 bp, Artificial Sequence
  Synthetic
caggtcgaacaucaggtcguc

SEQ ID NO: 100456 - DNA, 21 bp, Artificial Sequence
  Synthetic
cgcgttcauggtatgguccaa

SEQ ID NO: 100457 - DNA, 22 bp, Artificial Sequence
  Synthetic
ggatcttcucgctgtcctucag

SEQ ID NO: 100458 - DNA, 23 bp, Artificial Sequence
  Synthetic
agcutcaagaacaucaccaagca

SEQ ID NO: 100459 - DNA, 24 bp, Artificial Sequence
  Synthetic
agaaatucaagctcaggucgaaca

SEQ ID NO: 100460 - DNA, 19 bp, Artificial Sequence
  Synthetic
gggcaagcgcuggaaaaug

SEQ ID NO: 100461 - DNA, 19 bp, Artificial Sequence
  Synthetic
tcttctcugggctcuggct

SEQ ID NO: 100462 - DNA, 17 bp, Artificial Sequence
  Synthetic
acgccgacgaccugaug

SEQ ID NO: 100463 - DNA, 22 bp, Artificial Sequence
  Synthetic
ccctcgcugaacgaauccaaat

SEQ ID NO: 100464 - DNA, 22 bp, Artificial Sequence
  Synthetic
ccgacuaccccgactacaagua

SEQ ID NO: 100465 - DNA, 21 bp, Artificial Sequence
  Synthetic
gcatttcttgcuggagcccut

SEQ ID NO: 100466 - DNA, 20 bp, Artificial Sequence
  Synthetic
cctgtcgcuggtggauaagg

SEQ ID NO: 100467 - DNA, 21 bp, Artificial Sequence
  Synthetic
gaacaccaggucggagaagut

SEQ ID NO: 100468 - DNA, 21 bp, Artificial Sequence
  Synthetic
acttcgagtuccccgacuact

SEQ ID NO: 100469 - DNA, 22 bp, Artificial Sequence
  Synthetic
caccacuacaacttccucccaa

SEQ ID NO: 100470 - DNA, 28 bp, Artificial Sequence
  Synthetic
gtgtgagttttcauttaccacatctugt

SEQ ID NO: 100471 - DNA, 21 bp, Artificial Sequence
  Synthetic
ggtgaugagcagttgtuccag

SEQ ID NO: 100472 - DNA, 28 bp, Artificial Sequence
  Synthetic
gtttacctatcaguattagcctgctugt

SEQ ID NO: 100473 - DNA, 22 bp, Artificial Sequence
  Synthetic
cctggtcugatgatgtaugcca

SEQ ID NO: 100474 - DNA, 18 bp, Artificial Sequence
  Synthetic
tgtucccgcagccagaut

SEQ ID NO: 100475 - DNA, 24 bp, Artificial Sequence
  Synthetic
gatggagagaugtatccucccaca

SEQ ID NO: 100476 - DNA, 25 bp, Artificial Sequence
  Synthetic
tctctgccugagtatctttgacugt

SEQ ID NO: 100477 - DNA, 29 bp, Artificial Sequence
  Synthetic
caggtatgctucctttgactatuaagact

SEQ ID NO: 100478 - DNA, 22 bp, Artificial Sequence
  Synthetic
ggcaauagcacagcctctcaua

SEQ ID NO: 100479 - DNA, 24 bp, Artificial Sequence
  Synthetic
aactataagcugtggcatcuggac

SEQ ID NO: 100480 - DNA, 20 bp, Artificial Sequence
  Synthetic
ctcgggucagcagagtctug

SEQ ID NO: 100481 - DNA, 25 bp, Artificial Sequence
  Synthetic
cacccagaautctaacactguggag

SEQ ID NO: 100482 - DNA, 24 bp, Artificial Sequence
  Synthetic
ctcggatcucatactcaacaucgg

SEQ ID NO: 100483 - DNA, 21 bp, Artificial Sequence
  Synthetic
ccccaucatccugaaggaagt

SEQ ID NO: 100484 - DNA, 21 bp, Artificial Sequence
  Synthetic
cctgtgguggtgcgatatucc

SEQ ID NO: 100485 - DNA, 28 bp, Artificial Sequence
  Synthetic
tgacagtcctttutgattgcttgtctua

SEQ ID NO: 100486 - DNA, 21 bp, Artificial Sequence
  Synthetic
agcaaugcagcccgtcttaua

SEQ ID NO: 100487 - DNA, 27 bp, Artificial Sequence
  Synthetic
caacttacaatgcugactatggcuaca

SEQ ID NO: 100488 - DNA, 21 bp, Artificial Sequence
  Synthetic
gtgttguccacctgcttcuct

SEQ ID NO: 100489 - DNA, 28 bp, Artificial Sequence
  Synthetic
aggaagctgtugtcattatgatgatugt

SEQ ID NO: 100490 - DNA, 23 bp, Artificial Sequence
  Synthetic
gttagagaaggcutcccagctut

SEQ ID NO: 100491 - DNA, 27 bp, Artificial Sequence
  Synthetic
aggtgccacttuccacattttacaaua

SEQ ID NO: 100492 - DNA, 21 bp, Artificial Sequence
  Synthetic
catggaucaaggctgtgtugg

SEQ ID NO: 100493 - DNA, 26 bp, Artificial Sequence
  Synthetic
ctgcaactguttctgtgaaatugact

SEQ ID NO: 100494 - DNA, 22 bp, Artificial Sequence
  Synthetic
gggaggaucagcagaugagaaa

SEQ ID NO: 100495 - DNA, 19 bp, Artificial Sequence
  Synthetic
cggagcgucagcaaguacc

SEQ ID NO: 100496 - DNA, 21 bp, Artificial Sequence
  Synthetic
ccaucagagcggaucacacag

SEQ ID NO: 100497 - DNA, 25 bp, Artificial Sequence
  Synthetic
ctatgattcctccuctccctctcut

SEQ ID NO: 100498 - DNA, 21 bp, Artificial Sequence
  Synthetic
aagggatcuccctccaggtut

SEQ ID NO: 100499 - DNA, 24 bp, Artificial Sequence
  Synthetic
ttcgattacaacugctcctctgug

SEQ ID NO: 100500 - DNA, 24 bp, Artificial Sequence
  Synthetic
agtgtccatcucattcagcaucac

SEQ ID NO: 100501 - DNA, 23 bp, Artificial Sequence
  Synthetic
aagcctgtgucattcctttguca

SEQ ID NO: 100502 - DNA, 21 bp, Artificial Sequence
  Synthetic
cgagccugggatttgctcaua

SEQ ID NO: 100503 - DNA, 20 bp, Artificial Sequence
  Synthetic
gtgtttgugcacgaugccat

SEQ ID NO: 100504 - DNA, 24 bp, Artificial Sequence
  Synthetic
aguagagagaacggaacucacaca

SEQ ID NO: 100505 - DNA, 25 bp, Artificial Sequence
  Synthetic
ccacaacactaaaugtggacagcua

SEQ ID NO: 100506 - DNA, 20 bp, Artificial Sequence
  Synthetic
agagctccugagcccagtua

SEQ ID NO: 100507 - DNA, 27 bp, Artificial Sequence
  Synthetic
cgcctcucaggaacagtataaattugt

SEQ ID NO: 100508 - DNA, 19 bp, Artificial Sequence
  Synthetic
aatggcggccgugtactua

SEQ ID NO: 100509 - DNA, 27 bp, Artificial Sequence
  Synthetic
cttctgtgaccuctttccttatcucag

SEQ ID NO: 100510 - DNA, 28 bp, Artificial Sequence
  Synthetic
ctcctttaatgtuagcccttgactauga

SEQ ID NO: 100511 - DNA, 25 bp, Artificial Sequence
  Synthetic
cacttcacgcaucagttttucaaga

SEQ ID NO: 100512 - DNA, 20 bp, Artificial Sequence
  Synthetic
tggcccucgcttatgatcug

SEQ ID NO: 100513 - DNA, 28 bp, Artificial Sequence
  Synthetic
cttcctgatucaaatgagattguggaaa

SEQ ID NO: 100514 - DNA, 28 bp, Artificial Sequence
  Synthetic
agggatgaacuttcttctuagaagcaat

SEQ ID NO: 100515 - DNA, 26 bp, Artificial Sequence
  Synthetic
tcttggtagatugacagtcaccauct

SEQ ID NO: 100516 - DNA, 22 bp, Artificial Sequence
  Synthetic
tctgagcagaggcutctcucat

SEQ ID NO: 100517 - DNA, 28 bp, Artificial Sequence
  Synthetic
attctcttgtgtuctttggtttctcuct

SEQ ID NO: 100518 - DNA, 33 bp, Artificial Sequence
  Synthetic
ttgttatttttcttuagggataagagaagaucc

SEQ ID NO: 100519 - DNA, 28 bp, Artificial Sequence
  Synthetic
gcatttgtagcucaccgaactgtatuat

SEQ ID NO: 100520 - DNA, 20 bp, Artificial Sequence
  Synthetic
cccccaauctccccuaagga

SEQ ID NO: 100521 - DNA, 20 bp, Artificial Sequence
  Synthetic
ccatgccauctggcacauca

SEQ ID NO: 100522 - DNA, 20 bp, Artificial Sequence
  Synthetic
gcaugaggtagcuccaccct

SEQ ID NO: 100523 - DNA, 20 bp, Artificial Sequence
  Synthetic
gaggccuggcgtatttucac

SEQ ID NO: 100524 - DNA, 22 bp, Artificial Sequence
  Synthetic
gcccugcaacaattagtuggaa

SEQ ID NO: 100525 - DNA, 28 bp, Artificial Sequence
  Synthetic
ccatcagtcggauacacacatattcauc

SEQ ID NO: 100526 - DNA, 22 bp, Artificial Sequence
  Synthetic
ccugaaaaagaggacguggaca

SEQ ID NO: 100527 - DNA, 18 bp, Artificial Sequence
  Synthetic
cgtgguggtggtctugct

SEQ ID NO: 100528 - DNA, 21 bp, Artificial Sequence
  Synthetic
cttgggcutctccagcucaat

SEQ ID NO: 100529 - DNA, 21 bp, Artificial Sequence
  Synthetic
cctgcataccugtgggctaug

SEQ ID NO: 100530 - DNA, 19 bp, Artificial Sequence
  Synthetic
aagucaagcagcucgagca

SEQ ID NO: 100531 - DNA, 21 bp, Artificial Sequence
  Synthetic
aggagccgaaggaaugaguct

SEQ ID NO: 100532 - DNA, 24 bp, Artificial Sequence
  Synthetic
cctgguagccagaatcatuacagg

SEQ ID NO: 100533 - DNA, 28 bp, Artificial Sequence
  Synthetic
agcttgctaaguaattcagtggctatut

SEQ ID NO: 100534 - DNA, 23 bp, Artificial Sequence
  Synthetic
cattcttctcucccagctuacct

SEQ ID NO: 100535 - DNA, 22 bp, Artificial Sequence
  Synthetic
ggcugugacaaaaggaaaagca

SEQ ID NO: 100536 - DNA, 20 bp, Artificial Sequence
  Synthetic
ctcaccgaugcacccaugat

SEQ ID NO: 100537 - DNA, 24 bp, Artificial Sequence
  Synthetic
cttgtuaacgagcctttctuccac

SEQ ID NO: 100538 - DNA, 19 bp, Artificial Sequence
  Synthetic
gtgctuccctcctguccac

SEQ ID NO: 100539 - DNA, 18 bp, Artificial Sequence
  Synthetic
gcgaguggcgctgauacc

SEQ ID NO: 100540 - DNA, 22 bp, Artificial Sequence
  Synthetic
ccucctttucaagaggcccaaa

SEQ ID NO: 100541 - DNA, 23 bp, Artificial Sequence
  Synthetic
gactctgcugaaagtggtctuca

SEQ ID NO: 100542 - DNA, 23 bp, Artificial Sequence
  Synthetic
cggaagcaccacuauggagaaac

SEQ ID NO: 100543 - DNA, 28 bp, Artificial Sequence
  Synthetic
tcagtgtgcuaaccattgattattcuga

SEQ ID NO: 100544 - DNA, 20 bp, Artificial Sequence
  Synthetic
ttctcccaugccatguggac

SEQ ID NO: 100545 - DNA, 27 bp, Artificial Sequence
  Synthetic
ttatcaacggugaaagcctattgguat

SEQ ID NO: 100546 - DNA, 20 bp, Artificial Sequence
  Synthetic
gcagtggugggacacactua

SEQ ID NO: 100547 - DNA, 24 bp, Artificial Sequence
  Synthetic
tggaggatgaugtatgtaggucgt

SEQ ID NO: 100548 - DNA, 17 bp, Artificial Sequence
  Synthetic
agcuguaccgggagcgt

SEQ ID NO: 100549 - DNA, 22 bp, Artificial Sequence
  Synthetic
acagggaguagggagacacauc

SEQ ID NO: 100550 - DNA, 31 bp, Artificial Sequence
  Synthetic
cagtaaagtaggcauacttatatagtuggca

SEQ ID NO: 100551 - DNA, 28 bp, Artificial Sequence
  Synthetic
cgcaagaaaaucauagcagaaaacaaga

SEQ ID NO: 100552 - DNA, 28 bp, Artificial Sequence
  Synthetic
gggataaaacaguttctcttaagtggug

SEQ ID NO: 100553 - DNA, 28 bp, Artificial Sequence
  Synthetic
atttttctcttcuctgagctaacaugct

SEQ ID NO: 100554 - DNA, 27 bp, Artificial Sequence
  Synthetic
agatatttgtgcauggtgatggtagug

SEQ ID NO: 100555 - DNA, 27 bp, Artificial Sequence
  Synthetic
tgatctttgtguaggtggatgcaatut

SEQ ID NO: 100556 - DNA, 21 bp, Artificial Sequence
  Synthetic
ctcgattcugctcggttcuca

SEQ ID NO: 100557 - DNA, 17 bp, Artificial Sequence
  Synthetic
ccccggaaacggucgua

SEQ ID NO: 100558 - DNA, 21 bp, Artificial Sequence
  Synthetic
ggtccctcutcagtggcauat

SEQ ID NO: 100559 - DNA, 28 bp, Artificial Sequence
  Synthetic
attttgcagaactautatggagctgcua

SEQ ID NO: 100560 - DNA, 28 bp, Artificial Sequence
  Synthetic
ccaagtgggtugtcagaaaatatcauct

SEQ ID NO: 100561 - DNA, 31 bp, Artificial Sequence
  Synthetic
aagaaataatgtttgucgtaatttggctgut

SEQ ID NO: 100562 - DNA, 21 bp, Artificial Sequence
  Synthetic
ggacucggagguaaggaagca

SEQ ID NO: 100563 - DNA, 17 bp, Artificial Sequence
  Synthetic
gucccagcgggcacaua

SEQ ID NO: 100564 - DNA, 22 bp, Artificial Sequence
  Synthetic
ggaatgugcagctgaggucaat

SEQ ID NO: 100565 - DNA, 21 bp, Artificial Sequence
  Synthetic
gagctgaugaagagagugggt

SEQ ID NO: 100566 - DNA, 22 bp, Artificial Sequence
  Synthetic
tgtaggugccctcatacuggaa

SEQ ID NO: 100567 - DNA, 22 bp, Artificial Sequence
  Synthetic
tutatggcaggugaggaaaggg

SEQ ID NO: 100568 - DNA, 20 bp, Artificial Sequence
  Synthetic
tgcaagaggugacccaagug

SEQ ID NO: 100569 - DNA, 21 bp, Artificial Sequence
  Synthetic
cgaccaguccaccagatugag

SEQ ID NO: 100570 - DNA, 21 bp, Artificial Sequence
  Synthetic
gagcugcaggacgacttcuac

SEQ ID NO: 100571 - DNA, 21 bp, Artificial Sequence
  Synthetic
gtacatugaggtctgcuggga

SEQ ID NO: 100572 - DNA, 21 bp, Artificial Sequence
  Synthetic
ggacacgcucatagagtggug

SEQ ID NO: 100573 - DNA, 17 bp, Artificial Sequence
  Synthetic
cccccgaccgucuacga

SEQ ID NO: 100574 - DNA, 23 bp, Artificial Sequence
  Synthetic
ggactcgugaatgttcttgguga

SEQ ID NO: 100575 - DNA, 20 bp, Artificial Sequence
  Synthetic
tttgcccgcaacucctaugt

SEQ ID NO: 100576 - DNA, 23 bp, Artificial Sequence
  Synthetic
agagaaagutttggugagggcaa

SEQ ID NO: 100577 - DNA, 23 bp, Artificial Sequence
  Synthetic
tgtagaaauggccggatugaagt

SEQ ID NO: 100578 - DNA, 20 bp, Artificial Sequence
  Synthetic
ggaggcugcatcatcguact

SEQ ID NO: 100579 - DNA, 21 bp, Artificial Sequence
  Synthetic
gggctgacauctgtctgtgug

SEQ ID NO: 100580 - DNA, 23 bp, Artificial Sequence
  Synthetic
cgcuagcaagaccaaaaggatut

SEQ ID NO: 100581 - DNA, 23 bp, Artificial Sequence
  Synthetic
cagtcacaauatggagctuccgt

SEQ ID NO: 100582 - DNA, 21 bp, Artificial Sequence
  Synthetic
ggtagutcaggctuggcagaa

SEQ ID NO: 100583 - DNA, 22 bp, Artificial Sequence
  Synthetic
tcggatgcugtgttgaagugat

SEQ ID NO: 100584 - DNA, 21 bp, Artificial Sequence
  Synthetic
gcaagaagugggcaacaccua

SEQ ID NO: 100585 - DNA, 27 bp, Artificial Sequence
  Synthetic
gcatgaaaatgutgatgtgtctugcat

SEQ ID NO: 100586 - DNA, 29 bp, Artificial Sequence
  Synthetic
cctggcactuacttgattccataaauaac

SEQ ID NO: 100587 - DNA, 20 bp, Artificial Sequence
  Synthetic
agtcagcggaugcatgugat

SEQ ID NO: 100588 - DNA, 27 bp, Artificial Sequence
  Synthetic
gtctaataaagutcctgtcgtucagca

SEQ ID NO: 100589 - DNA, 20 bp, Artificial Sequence
  Synthetic
cctgaguggcagacgactua

SEQ ID NO: 100590 - DNA, 22 bp, Artificial Sequence
  Synthetic
cucccccaagauagggaagagt

SEQ ID NO: 100591 - DNA, 20 bp, Artificial Sequence
  Synthetic
aacatcgccugcgttaucct

SEQ ID NO: 100592 - DNA, 23 bp, Artificial Sequence
  Synthetic
ttggtcccttuctttgcactgua

SEQ ID NO: 100593 - DNA, 22 bp, Artificial Sequence
  Synthetic
gacccaucgcctttgatgauga

SEQ ID NO: 100594 - DNA, 20 bp, Artificial Sequence
  Synthetic
ccaaagggcucctugaaggt

SEQ ID NO: 100595 - DNA, 21 bp, Artificial Sequence
  Synthetic
ccuccagaacucagacaaggg

SEQ ID NO: 100596 - DNA, 17 bp, Artificial Sequence
  Synthetic
cctcaccucgcctuggt

SEQ ID NO: 100597 - DNA, 17 bp, Artificial Sequence
  Synthetic
cgcuccuccgggagaca

SEQ ID NO: 100598 - DNA, 18 bp, Artificial Sequence
  Synthetic
cgccucactgtgctuggt

SEQ ID NO: 100599 - DNA, 18 bp, Artificial Sequence
  Synthetic
ccgcaggcutaccgugaa

SEQ ID NO: 100600 - DNA, 18 bp, Artificial Sequence
  Synthetic
cccguacctcuccaacgg

SEQ ID NO: 100601 - DNA, 17 bp, Artificial Sequence
  Synthetic
tugggaucggcgcagaa

SEQ ID NO: 100602 - DNA, 27 bp, Artificial Sequence
  Synthetic
accaggutatcatcuaaaaacgacagg

SEQ ID NO: 100603 - DNA, 28 bp, Artificial Sequence
  Synthetic
ctgagacaacguacgacaaaatatugaa

SEQ ID NO: 100604 - DNA, 28 bp, Artificial Sequence
  Synthetic
caccagccttcuatttctggataagtut

SEQ ID NO: 100605 - DNA, 26 bp, Artificial Sequence
  Synthetic
gggttgtgtcutaactgcaatacaut

SEQ ID NO: 100606 - DNA, 27 bp, Artificial Sequence
  Synthetic
caatatttacaauagcgggcaacugat

SEQ ID NO: 100607 - DNA, 21 bp, Artificial Sequence
  Synthetic
tgaacaggauccagagcuggt

SEQ ID NO: 100608 - DNA, 19 bp, Artificial Sequence
  Synthetic
accctccacacugctccut

SEQ ID NO: 100609 - DNA, 17 bp, Artificial Sequence
  Synthetic
tggtgauccgcgugcag

SEQ ID NO: 100610 - DNA, 25 bp, Artificial Sequence
  Synthetic
caagcugtattctguacccacagat

SEQ ID NO: 100611 - DNA, 24 bp, Artificial Sequence
  Synthetic
ctagatgccugaaatgtgcagaug

SEQ ID NO: 100612 - DNA, 25 bp, Artificial Sequence
  Synthetic
attagtuggacagctcttcugacac

SEQ ID NO: 100613 - DNA, 28 bp, Artificial Sequence
  Synthetic
ttactagacacggacuctgaatgaguat

SEQ ID NO: 100614 - DNA, 24 bp, Artificial Sequence
  Synthetic
ccagacccaagucagtgacattua

SEQ ID NO: 100615 - DNA, 24 bp, Artificial Sequence
  Synthetic
ccagataaacaaauggcagtgcut

SEQ ID NO: 100616 - DNA, 19 bp, Artificial Sequence
  Synthetic
gcgaacgacgagcugaucc

SEQ ID NO: 100617 - DNA, 17 bp, Artificial Sequence
  Synthetic
gccgcggugcttcctua

SEQ ID NO: 100618 - DNA, 19 bp, Artificial Sequence
  Synthetic
guaggccacacagccauca

SEQ ID NO: 100619 - DNA, 17 bp, Artificial Sequence
  Synthetic
ccutcgcgcugagcagt

SEQ ID NO: 100620 - DNA, 21 bp, Artificial Sequence
  Synthetic
ggagggaacggutctuacagt

SEQ ID NO: 100621 - DNA, 22 bp, Artificial Sequence
  Synthetic
gaagttaugggatgtcguggct

SEQ ID NO: 100622 - DNA, 33 bp, Artificial Sequence
  Synthetic
agaatattaaaccagutttatttttcagcaugt

SEQ ID NO: 100623 - DNA, 28 bp, Artificial Sequence
  Synthetic
gactccaccatuttcttcctcttcauaa

SEQ ID NO: 100624 - DNA, 18 bp, Artificial Sequence
  Synthetic
ccucgggaggcctctuac

SEQ ID NO: 100625 - DNA, 20 bp, Artificial Sequence
  Synthetic
cccaggcutaacgtgcatuc

SEQ ID NO: 100626 - DNA, 18 bp, Artificial Sequence
  Synthetic
ggtguacacggcctcgut

SEQ ID NO: 100627 - DNA, 17 bp, Artificial Sequence
  Synthetic
gcccttuccgccacgua

SEQ ID NO: 100628 - DNA, 21 bp, Artificial Sequence
  Synthetic
ccgattccgcuctcttcuagg

SEQ ID NO: 100629 - DNA, 27 bp, Artificial Sequence
  Synthetic
tgtctcatgugccattttctctttuct

SEQ ID NO: 100630 - DNA, 21 bp, Artificial Sequence
  Synthetic
ttgtgugacacctgacaugct

SEQ ID NO: 100631 - DNA, 25 bp, Artificial Sequence
  Synthetic
ggccctcauctccttcatauacaac

SEQ ID NO: 100632 - DNA, 25 bp, Artificial Sequence
  Synthetic
tgtggagugaggtaatttucagcat

SEQ ID NO: 100633 - DNA, 24 bp, Artificial Sequence
  Synthetic
tgctgtcttuagagtatccuggct

SEQ ID NO: 100634 - DNA, 28 bp, Artificial Sequence
  Synthetic
ggagtacaacuccatattttctgauggt

SEQ ID NO: 100635 - DNA, 21 bp, Artificial Sequence
  Synthetic
ctggagacacugccttugact

SEQ ID NO: 100636 - DNA, 23 bp, Artificial Sequence
  Synthetic
aagaagccuctgaatgcctucat

SEQ ID NO: 100637 - DNA, 20 bp, Artificial Sequence
  Synthetic
agggagagggcagguctuac

SEQ ID NO: 100638 - DNA, 18 bp, Artificial Sequence
  Synthetic
cctgugaggaccggccua

SEQ ID NO: 100639 - DNA, 19 bp, Artificial Sequence
  Synthetic
ccaggtgcuccgtgtacug

SEQ ID NO: 100640 - DNA, 21 bp, Artificial Sequence
  Synthetic
tctggaatcacucgagccuga

SEQ ID NO: 100641 - DNA, 20 bp, Artificial Sequence
  Synthetic
ggttgtccugtcagcgtgut

SEQ ID NO: 100642 - DNA, 22 bp, Artificial Sequence
  Synthetic
caacguagagcagatgtugcac

SEQ ID NO: 100643 - DNA, 23 bp, Artificial Sequence
  Synthetic
gagctgtcaugcagaaatggtut

SEQ ID NO: 100644 - DNA, 19 bp, Artificial Sequence
  Synthetic
gaccgcugtatccgctuct

SEQ ID NO: 100645 - DNA, 18 bp, Artificial Sequence
  Synthetic
cacatccugaggccuggt

SEQ ID NO: 100646 - DNA, 18 bp, Artificial Sequence
  Synthetic
gcucuagggccgggaaca

SEQ ID NO: 100647 - DNA, 19 bp, Artificial Sequence
  Synthetic
gatgggcugggacccuaac

SEQ ID NO: 100648 - DNA, 27 bp, Artificial Sequence
  Synthetic
gatctgaaauagaaaccaaggcugagt

SEQ ID NO: 100649 - DNA, 24 bp, Artificial Sequence
  Synthetic
gaactacaagacugggauggacag

SEQ ID NO: 100650 - DNA, 31 bp, Artificial Sequence
  Synthetic
ttgagctagagcaguagaaataacaugaaaa

SEQ ID NO: 100651 - DNA, 28 bp, Artificial Sequence
  Synthetic
gtagttctguagccattgctattctugt

SEQ ID NO: 100652 - DNA, 21 bp, Artificial Sequence
  Synthetic
cagggatugcagaggcgtaut

SEQ ID NO: 100653 - DNA, 20 bp, Artificial Sequence
  Synthetic
gggcgcuctgaatcactucc

SEQ ID NO: 100654 - DNA, 24 bp, Artificial Sequence
  Synthetic
ctgctagacucatgtagatuggct

SEQ ID NO: 100655 - DNA, 17 bp, Artificial Sequence
  Synthetic
cgcggtuggtcctgcua

SEQ ID NO: 100656 - DNA, 18 bp, Artificial Sequence
  Synthetic
gtacgcagucgcgguaca

SEQ ID NO: 100657 - DNA, 22 bp, Artificial Sequence
  Synthetic
ctccggaaguggaagcttcaua

SEQ ID NO: 100658 - DNA, 22 bp, Artificial Sequence
  Synthetic
ggtgacucacagtagcuggact

SEQ ID NO: 100659 - DNA, 24 bp, Artificial Sequence
  Synthetic
ttggttgacugctctgtctttuct

SEQ ID NO: 100660 - DNA, 20 bp, Artificial Sequence
  Synthetic
gcugguagagagggcagaac

SEQ ID NO: 100661 - DNA, 19 bp, Artificial Sequence
  Synthetic
ggccutcugcccgaaaaca

SEQ ID NO: 100662 - DNA, 20 bp, Artificial Sequence
  Synthetic
accccauagcccacagguat

SEQ ID NO: 100663 - DNA, 22 bp, Artificial Sequence
  Synthetic
caagacacuctctcccucacag

SEQ ID NO: 100664 - DNA, 20 bp, Artificial Sequence
  Synthetic
ggcauagcccacgaugaagg

SEQ ID NO: 100665 - DNA, 21 bp, Artificial Sequence
  Synthetic
accccaccauctggtaagugt

SEQ ID NO: 100666 - DNA, 22 bp, Artificial Sequence
  Synthetic
gcgagggaacaguctgacauat

SEQ ID NO: 100667 - DNA, 21 bp, Artificial Sequence
  Synthetic
agagaggcugtgggttcctua

SEQ ID NO: 100668 - DNA, 18 bp, Artificial Sequence
  Synthetic
ggccucgaaggcaucacc

SEQ ID NO: 100669 - DNA, 18 bp, Artificial Sequence
  Synthetic
tgtggtccugggccagua

SEQ ID NO: 100670 - DNA, 20 bp, Artificial Sequence
  Synthetic
cgtccagguaccctttggug

SEQ ID NO: 100671 - DNA, 23 bp, Artificial Sequence
  Synthetic
cattctctcccutggctttcuct

SEQ ID NO: 100672 - DNA, 24 bp, Artificial Sequence
  Synthetic
gcatcccuagcacattttguaggt

SEQ ID NO: 100673 - DNA, 26 bp, Artificial Sequence
  Synthetic
gcagaggtatuacaatgccttgauct

SEQ ID NO: 100674 - DNA, 28 bp, Artificial Sequence
  Synthetic
acattcaccaacutatgccaattctcut

SEQ ID NO: 100675 - DNA, 28 bp, Artificial Sequence
  Synthetic
tcctttctgaatautgagctcatcagug

SEQ ID NO: 100676 - DNA, 22 bp, Artificial Sequence
  Synthetic
cctcuaccccaagagtctcuct

SEQ ID NO: 100677 - DNA, 22 bp, Artificial Sequence
  Synthetic
cgactatggcuacaacctggug

SEQ ID NO: 100678 - DNA, 27 bp, Artificial Sequence
  Synthetic
aaatctcauttcagcattucagaagcc

SEQ ID NO: 100679 - DNA, 23 bp, Artificial Sequence
  Synthetic
tgagctuccaaaccctgucaaaa

SEQ ID NO: 100680 - DNA, 22 bp, Artificial Sequence
  Synthetic
gacaccaataugcagccgttut

SEQ ID NO: 100681 - DNA, 27 bp, Artificial Sequence
  Synthetic
catcaggacatugtgacaaatgttucc

SEQ ID NO: 100682 - DNA, 20 bp, Artificial Sequence
  Synthetic
gcctcaccaauagccacgut

SEQ ID NO: 100683 - DNA, 19 bp, Artificial Sequence
  Synthetic
cctcugagcaacccuggac

SEQ ID NO: 100684 - DNA, 20 bp, Artificial Sequence
  Synthetic
ggtgaggcucctgaguacca

SEQ ID NO: 100685 - DNA, 21 bp, Artificial Sequence
  Synthetic
gctguccaaccacatctccuc

SEQ ID NO: 100686 - DNA, 19 bp, Artificial Sequence
  Synthetic
ggcaaagcucacacugacc

SEQ ID NO: 100687 - DNA, 21 bp, Artificial Sequence
  Synthetic
actgucaagagccccaucaga

SEQ ID NO: 100688 - DNA, 17 bp, Artificial Sequence
  Synthetic
ggtcccauggctgguga

SEQ ID NO: 100689 - DNA, 19 bp, Artificial Sequence
  Synthetic
ggatguccctcugcaggat

SEQ ID NO: 100690 - DNA, 20 bp, Artificial Sequence
  Synthetic
tggaatgcugagcagctguc

SEQ ID NO: 100691 - DNA, 18 bp, Artificial Sequence
  Synthetic
gaggagcuggtggtcugt

SEQ ID NO: 100692 - DNA, 17 bp, Artificial Sequence
  Synthetic
aggtgugcgggcucaag

SEQ ID NO: 100693 - DNA, 19 bp, Artificial Sequence
  Synthetic
ctctuccgttccugccagt

SEQ ID NO: 100694 - DNA, 21 bp, Artificial Sequence
  Synthetic
agauctggtccucacggaaca

SEQ ID NO: 100695 - DNA, 21 bp, Artificial Sequence
  Synthetic
gatgcagcuctgatccucact

SEQ ID NO: 100696 - DNA, 18 bp, Artificial Sequence
  Synthetic
gcucagcgcatcugccat

SEQ ID NO: 100697 - DNA, 20 bp, Artificial Sequence
  Synthetic
ggaaggcagaguccaugcaa

SEQ ID NO: 100698 - DNA, 19 bp, Artificial Sequence
  Synthetic
gcccccagggutcgattut

SEQ ID NO: 100699 - DNA, 19 bp, Artificial Sequence
  Synthetic
cgtgaagccucatgcuggt

SEQ ID NO: 100700 - DNA, 22 bp, Artificial Sequence
  Synthetic
ggatgtagagcuccacctucct

SEQ ID NO: 100701 - DNA, 20 bp, Artificial Sequence
  Synthetic
cgtggccucgtttctcaaug

SEQ ID NO: 100702 - DNA, 19 bp, Artificial Sequence
  Synthetic
gguagcggcagagcaucac

SEQ ID NO: 100703 - DNA, 24 bp, Artificial Sequence
  Synthetic
caaacctcctucatctgctcctut

SEQ ID NO: 100704 - DNA, 26 bp, Artificial Sequence
  Synthetic
tgttatacctgcuttactgccttugg

SEQ ID NO: 100705 - DNA, 27 bp, Artificial Sequence
  Synthetic
cccctcctccugctaatgatatttuat

SEQ ID NO: 100706 - DNA, 19 bp, Artificial Sequence
  Synthetic
cctgcautgatggcuccgt

SEQ ID NO: 100707 - DNA, 20 bp, Artificial Sequence
  Synthetic
ctgcccagagugtgcactua

SEQ ID NO: 100708 - DNA, 20 bp, Artificial Sequence
  Synthetic
ctcagugcctcgucacagat

SEQ ID NO: 100709 - DNA, 21 bp, Artificial Sequence
  Synthetic
acctactgcagaugctgtguc

SEQ ID NO: 100710 - DNA, 21 bp, Artificial Sequence
  Synthetic
gacgtcauctgagttggugga

SEQ ID NO: 100711 - DNA, 21 bp, Artificial Sequence
  Synthetic
gccctugaaccaggugaacag

SEQ ID NO: 100712 - DNA, 17 bp, Artificial Sequence
  Synthetic
cctcgtugccccucacc

SEQ ID NO: 100713 - DNA, 18 bp, Artificial Sequence
  Synthetic
agtgccuggcgtgaacuc

SEQ ID NO: 100714 - DNA, 21 bp, Artificial Sequence
  Synthetic
gcctcatcucaccaacagcut

SEQ ID NO: 100715 - DNA, 26 bp, Artificial Sequence
  Synthetic
ggtgctttaaggugaaacagactuac

SEQ ID NO: 100716 - DNA, 23 bp, Artificial Sequence
  Synthetic
ccattaccucagacttctuggca

SEQ ID NO: 100717 - DNA, 31 bp, Artificial Sequence
  Synthetic
tttgtgtacaacuggataactacttgaacut

SEQ ID NO: 100718 - DNA, 25 bp, Artificial Sequence
  Synthetic
ctcctcccaccucttaaagttauga

SEQ ID NO: 100719 - DNA, 27 bp, Artificial Sequence
  Synthetic
cacggaggautaaaacttucaagacaa

SEQ ID NO: 100720 - DNA, 22 bp, Artificial Sequence
  Synthetic
agaacugaaccaaaggcacuga

SEQ ID NO: 100721 - DNA, 22 bp, Artificial Sequence
  Synthetic
ctguccccacggaaggttauag

SEQ ID NO: 100722 - DNA, 27 bp, Artificial Sequence
  Synthetic
gcatagcaacaautctcccacctttua

SEQ ID NO: 100723 - DNA, 31 bp, Artificial Sequence
  Synthetic
attttcaagtttctuctctgttctgtttugt

SEQ ID NO: 100724 - DNA, 24 bp, Artificial Sequence
  Synthetic
gcaatgaacucatttgtuccccaa

SEQ ID NO: 100725 - DNA, 28 bp, Artificial Sequence
  Synthetic
gcagaattgugagaagctggagaauaat

SEQ ID NO: 100726 - DNA, 23 bp, Artificial Sequence
  Synthetic
aagagtcgugtgcttgatgucat

SEQ ID NO: 100727 - DNA, 33 bp, Artificial Sequence
  Synthetic
acatttttgcataacugcatagatacaatttut

SEQ ID NO: 100728 - DNA, 19 bp, Artificial Sequence
  Synthetic
ctcucggtgcugagagcaa

SEQ ID NO: 100729 - DNA, 23 bp, Artificial Sequence
  Synthetic
cctcacgutaatcctguggaagt

SEQ ID NO: 100730 - DNA, 26 bp, Artificial Sequence
  Synthetic
actcctttcuttttgagcaguacaca

SEQ ID NO: 100731 - DNA, 26 bp, Artificial Sequence
  Synthetic
ctgatgcctguttttctttctcctut

SEQ ID NO: 100732 - DNA, 23 bp, Artificial Sequence
  Synthetic
ctaccacgcuactaccataugcc

SEQ ID NO: 100733 - DNA, 21 bp, Artificial Sequence
  Synthetic
ggagtucaccaggccacatut

SEQ ID NO: 100734 - DNA, 18 bp, Artificial Sequence
  Synthetic
gagccaacuggagcguga

SEQ ID NO: 100735 - DNA, 17 bp, Artificial Sequence
  Synthetic
cgaggagcccgcutgut

SEQ ID NO: 100736 - DNA, 24 bp, Artificial Sequence
  Synthetic
tutggaaagagcugaacacaagga

SEQ ID NO: 100737 - DNA, 24 bp, Artificial Sequence
  Synthetic
ctgcaucaaaatggttuccaggac

SEQ ID NO: 100738 - DNA, 28 bp, Artificial Sequence
  Synthetic
aagtttattctutcacaggtaucacggt

SEQ ID NO: 100739 - DNA, 28 bp, Artificial Sequence
  Synthetic
aaccagcctaaauttcaaatacctccut

SEQ ID NO: 100740 - DNA, 21 bp, Artificial Sequence
  Synthetic
ctgcccugagctttcccaaua

SEQ ID NO: 100741 - DNA, 22 bp, Artificial Sequence
  Synthetic
gcuaagacaaacaugcggacag

SEQ ID NO: 100742 - DNA, 25 bp, Artificial Sequence
  Synthetic
gcctctcttuggttcataaggtgut

SEQ ID NO: 100743 - DNA, 28 bp, Artificial Sequence
  Synthetic
cagtgacatcaauaccctctatttcugt

SEQ ID NO: 100744 - DNA, 26 bp, Artificial Sequence
  Synthetic
ctgaaggcagucattcttctggauat

SEQ ID NO: 100745 - DNA, 27 bp, Artificial Sequence
  Synthetic
gataatttgcgguaaaagccttucagt

SEQ ID NO: 100746 - DNA, 22 bp, Artificial Sequence
  Synthetic
cacugaaaggctttuaccgcaa

SEQ ID NO: 100747 - DNA, 28 bp, Artificial Sequence
  Synthetic
tggaatctcauagaatttttggcugact

SEQ ID NO: 100748 - DNA, 18 bp, Artificial Sequence
  Synthetic
cuacccgcagagcacucc

SEQ ID NO: 100749 - DNA, 21 bp, Artificial Sequence
  Synthetic
actggcagacucgagactgua

SEQ ID NO: 100750 - DNA, 21 bp, Artificial Sequence
  Synthetic
gggagttggcaugaccctcua

SEQ ID NO: 100751 - DNA, 22 bp, Artificial Sequence
  Synthetic
cctccttaggugtccctcaaug

SEQ ID NO: 100752 - DNA, 18 bp, Artificial Sequence
  Synthetic
ctctgcccaugcctucca

SEQ ID NO: 100753 - DNA, 18 bp, Artificial Sequence
  Synthetic
gccucagggagcucacca

SEQ ID NO: 100754 - DNA, 23 bp, Artificial Sequence
  Synthetic
ggaaaacuguggaccagaaccat

SEQ ID NO: 100755 - DNA, 24 bp, Artificial Sequence
  Synthetic
ttcccaaaggugaaatggatguga

SEQ ID NO: 100756 - DNA, 24 bp, Artificial Sequence
  Synthetic
agtggaaatgauggcaaatgccua

SEQ ID NO: 100757 - DNA, 27 bp, Artificial Sequence
  Synthetic
cagaaactaugcaaactagugaagcat

SEQ ID NO: 100758 - DNA, 26 bp, Artificial Sequence
  Synthetic
tgttttgcuccatcatttcugacact

SEQ ID NO: 100759 - DNA, 26 bp, Artificial Sequence
  Synthetic
cctgcaagtauaagttgtgcttccut

SEQ ID NO: 100760 - DNA, 18 bp, Artificial Sequence
  Synthetic
ctgccccacucacctcuc

SEQ ID NO: 100761 - DNA, 23 bp, Artificial Sequence
  Synthetic
ggcatcgugttctcattcuggat

SEQ ID NO: 100762 - DNA, 18 bp, Artificial Sequence
  Synthetic
cctgctucgccagaucgt

SEQ ID NO: 100763 - DNA, 17 bp, Artificial Sequence
  Synthetic
ggacaccugaggcugct

SEQ ID NO: 100764 - DNA, 22 bp, Artificial Sequence
  Synthetic
acatcaccaccugcaaauaccc

SEQ ID NO: 100765 - DNA, 28 bp, Artificial Sequence
  Synthetic
ggaattgtctgtugactagtgattguct

SEQ ID NO: 100766 - DNA, 21 bp, Artificial Sequence
  Synthetic
gaguaccccaaucgagccaaa

SEQ ID NO: 100767 - DNA, 24 bp, Artificial Sequence
  Synthetic
catgacaatugatttccccguagg

SEQ ID NO: 100768 - DNA, 20 bp, Artificial Sequence
  Synthetic
ggacatgccugtgccctuaa

SEQ ID NO: 100769 - DNA, 21 bp, Artificial Sequence
  Synthetic
ccaccaugugaggagagaacc

SEQ ID NO: 100770 - DNA, 24 bp, Artificial Sequence
  Synthetic
tgactccaaauaggagacgucaga

SEQ ID NO: 100771 - DNA, 26 bp, Artificial Sequence
  Synthetic
tggaagcaggucttttatttggguaa

SEQ ID NO: 100772 - DNA, 22 bp, Artificial Sequence
  Synthetic
cgccaaaaucatccctgtguct

SEQ ID NO: 100773 - DNA, 21 bp, Artificial Sequence
  Synthetic
gcaggtacugaacacauggct

SEQ ID NO: 100774 - DNA, 19 bp, Artificial Sequence
  Synthetic
cuggccuccaagagcaaga

SEQ ID NO: 100775 - DNA, 18 bp, Artificial Sequence
  Synthetic
ggcttgcuccgaaugggt

SEQ ID NO: 100776 - DNA, 19 bp, Artificial Sequence
  Synthetic
cacagccuggtctccaguc

SEQ ID NO: 100777 - DNA, 19 bp, Artificial Sequence
  Synthetic
gaatccaggcugccgctua

SEQ ID NO: 100778 - DNA, 19 bp, Artificial Sequence
  Synthetic
ccactcccuctgcagctut

SEQ ID NO: 100779 - DNA, 19 bp, Artificial Sequence
  Synthetic
caucugcccagaggaggag

SEQ ID NO: 100780 - DNA, 18 bp, Artificial Sequence
  Synthetic
cagctggcuctccacuct

SEQ ID NO: 100781 - DNA, 18 bp, Artificial Sequence
  Synthetic
agagctgugggcauggac

SEQ ID NO: 100782 - DNA, 17 bp, Artificial Sequence
  Synthetic
ccagccucccctccugt

SEQ ID NO: 100783 - DNA, 21 bp, Artificial Sequence
  Synthetic
ggagcttagugggcagactug

SEQ ID NO: 100784 - DNA, 17 bp, Artificial Sequence
  Synthetic
gggcagacucgcuccaa

SEQ ID NO: 100785 - DNA, 20 bp, Artificial Sequence
  Synthetic
agagctgugtgcctcaaugg

SEQ ID NO: 100786 - DNA, 20 bp, Artificial Sequence
  Synthetic
cagcctcuttccctggucac

SEQ ID NO: 100787 - DNA, 23 bp, Artificial Sequence
  Synthetic
tgctgttgtuaccagccacttua

SEQ ID NO: 100788 - DNA, 21 bp, Artificial Sequence
  Synthetic
gaactgggagucaggtggtug

SEQ ID NO: 100789 - DNA, 21 bp, Artificial Sequence
  Synthetic
ccggtttcccugctgatttug

SEQ ID NO: 100790 - DNA, 20 bp, Artificial Sequence
  Synthetic
ggacgcaguggctgtgtauc

SEQ ID NO: 100791 - DNA, 20 bp, Artificial Sequence
  Synthetic
gcccatguccaccgtaucat

SEQ ID NO: 100792 - DNA, 23 bp, Artificial Sequence
  Synthetic
gatcccttttcugctgctgtgua

SEQ ID NO: 100793 - DNA, 21 bp, Artificial Sequence
  Synthetic
ctcagcacugacauccagacc

SEQ ID NO: 100794 - DNA, 26 bp, Artificial Sequence
  Synthetic
autcttttaccucaaaaccacccaat

SEQ ID NO: 100795 - DNA, 26 bp, Artificial Sequence
  Synthetic
gtattcauggaagatgtuggagcaga

SEQ ID NO: 100796 - DNA, 28 bp, Artificial Sequence
  Synthetic
tgctattctccutactccaaatgtugac

SEQ ID NO: 100797 - DNA, 24 bp, Artificial Sequence
  Synthetic
tcagcagacaacautggauacacc

SEQ ID NO: 100798 - DNA, 28 bp, Artificial Sequence
  Synthetic
gaaacacaaugaagagaaaauggaagca

SEQ ID NO: 100799 - DNA, 22 bp, Artificial Sequence
  Synthetic
gtttgtccuttccctugagcag

SEQ ID NO: 100800 - DNA, 28 bp, Artificial Sequence
  Synthetic
gcgtataucacacaaagtaugacccaat

SEQ ID NO: 100801 - DNA, 24 bp, Artificial Sequence
  Synthetic
gugaaaguaaccacagcaaccaag

SEQ ID NO: 100802 - DNA, 26 bp, Artificial Sequence
  Synthetic
tgcacaaaauacatactgauccaggt

SEQ ID NO: 100803 - DNA, 25 bp, Artificial Sequence
  Synthetic
cacccctucccttaaacttctuaca

SEQ ID NO: 100804 - DNA, 27 bp, Artificial Sequence
  Synthetic
aatggataccttutgcgttctagtuga

SEQ ID NO: 100805 - DNA, 27 bp, Artificial Sequence
  Synthetic
tgtctctaatgcgguctcataatgaug

SEQ ID NO: 100806 - DNA, 23 bp, Artificial Sequence
  Synthetic
agctttttgauctggagcucgat

SEQ ID NO: 100807 - DNA, 23 bp, Artificial Sequence
  Synthetic
gagutgaggaugaagcagaacct

SEQ ID NO: 100808 - DNA, 22 bp, Artificial Sequence
  Synthetic
gttaaactgcugccacttcugg

SEQ ID NO: 100809 - DNA, 28 bp, Artificial Sequence
  Synthetic
ctgccaaccuatgtttaaagcattucat

SEQ ID NO: 100810 - DNA, 26 bp, Artificial Sequence
  Synthetic
caaaacuggaagaacatcagaaugct

SEQ ID NO: 100811 - DNA, 26 bp, Artificial Sequence
  Synthetic
ttcctttctgutcttatagacgugcc

SEQ ID NO: 100812 - DNA, 21 bp, Artificial Sequence
  Synthetic
ttctgcgcccacuagcatuat

SEQ ID NO: 100813 - DNA, 28 bp, Artificial Sequence
  Synthetic
ctgttttaaaccauagtgagtttgugct

SEQ ID NO: 100814 - DNA, 24 bp, Artificial Sequence
  Synthetic
gggaaactgtuctcttccattcuc

SEQ ID NO: 100815 - DNA, 22 bp, Artificial Sequence
  Synthetic
gaggauaaacctgtugccacca

SEQ ID NO: 100816 - DNA, 22 bp, Artificial Sequence
  Synthetic
gcctgcagcucctgtatgtuac

SEQ ID NO: 100817 - DNA, 28 bp, Artificial Sequence
  Synthetic
tttcaaaggaagcugtggtacaatauga

SEQ ID NO: 100818 - DNA, 22 bp, Artificial Sequence
  Synthetic
cctgggtugagttccaactuga

SEQ ID NO: 100819 - DNA, 25 bp, Artificial Sequence
  Synthetic
tcaaagcuguacaagaaagcaggat

SEQ ID NO: 100820 - DNA, 27 bp, Artificial Sequence
  Synthetic
ttttgtaggttcugcagcatatctuga

SEQ ID NO: 100821 - DNA, 23 bp, Artificial Sequence
  Synthetic
cacccacacacauagtgauacca

SEQ ID NO: 100822 - DNA, 26 bp, Artificial Sequence
  Synthetic
agctagagagagguaggaaacactut

SEQ ID NO: 100823 - DNA, 22 bp, Artificial Sequence
  Synthetic
ccucgtuaaaagcagggaacag

SEQ ID NO: 100824 - DNA, 22 bp, Artificial Sequence
  Synthetic
caacatcgcuctcctccttcuc

SEQ ID NO: 100825 - DNA, 25 bp, Artificial Sequence
  Synthetic
agtggagccacuttggtatcatuac

SEQ ID NO: 100826 - DNA, 26 bp, Artificial Sequence
  Synthetic
aautgataagcuaaccagagccagac

SEQ ID NO: 100827 - DNA, 22 bp, Artificial Sequence
  Synthetic
tcctuggtcagaaugagaggaa

SEQ ID NO: 100828 - DNA, 27 bp, Artificial Sequence
  Synthetic
gggctgtatcuaactaaagtgtttuga

SEQ ID NO: 100829 - DNA, 25 bp, Artificial Sequence
  Synthetic
atcagaaggaagcaaugcacauact

SEQ ID NO: 100830 - DNA, 22 bp, Artificial Sequence
  Synthetic
tccagcagugaaaatggcuaca

SEQ ID NO: 100831 - DNA, 28 bp, Artificial Sequence
  Synthetic
ctggaaattggguacgatactgtatcut

SEQ ID NO: 100832 - DNA, 25 bp, Artificial Sequence
  Synthetic
ttctgcttttccugtagcaagauca

SEQ ID NO: 100833 - DNA, 28 bp, Artificial Sequence
  Synthetic
acaagtguggccagagaagttaaaauat

SEQ ID NO: 100834 - DNA, 28 bp, Artificial Sequence
  Synthetic
tttaagatatgauggcacccacatacug

SEQ ID NO: 100835 - DNA, 25 bp, Artificial Sequence
  Synthetic
tctccttcuagcaagtgaggatuct

SEQ ID NO: 100836 - DNA, 21 bp, Artificial Sequence
  Synthetic
cctcatccacucttgctcuca

SEQ ID NO: 100837 - DNA, 29 bp, Artificial Sequence
  Synthetic
agacaagaggutttagagagtagucaagt

SEQ ID NO: 100838 - DNA, 24 bp, Artificial Sequence
  Synthetic
gcacaagaaucctaugaaaaggca

SEQ ID NO: 100839 - DNA, 21 bp, Artificial Sequence
  Synthetic
gattcaugcacacgucaagca

SEQ ID NO: 100840 - DNA, 18 bp, Artificial Sequence
  Synthetic
gcctuggccttgcuccat

SEQ ID NO: 100841 - DNA, 22 bp, Artificial Sequence
  Synthetic
gctggtggtutcccattctcua

SEQ ID NO: 100842 - DNA, 20 bp, Artificial Sequence
  Synthetic
cccctagugagctacgcugt

SEQ ID NO: 100843 - DNA, 23 bp, Artificial Sequence
  Synthetic
ctaactgggaucgctauggcaat

SEQ ID NO: 100844 - DNA, 20 bp, Artificial Sequence
  Synthetic
gcttgcagacuagccacugt

SEQ ID NO: 100845 - DNA, 28 bp, Artificial Sequence
  Synthetic
gaagaagctgagaaugtgatgaaatuca

SEQ ID NO: 100846 - DNA, 21 bp, Artificial Sequence
  Synthetic
actgagcgguggtttcatuca

SEQ ID NO: 100847 - DNA, 26 bp, Artificial Sequence
  Synthetic
tgatggatactautgcacaccaaugt

SEQ ID NO: 100848 - DNA, 23 bp, Artificial Sequence
  Synthetic
gttcattcctagugctgggtgua

SEQ ID NO: 100849 - DNA, 29 bp, Artificial Sequence
  Synthetic
gaagatgttcgtuggttggtattctauga

SEQ ID NO: 100850 - DNA, 22 bp, Artificial Sequence
  Synthetic
ccacccgcacuagccttatuaa

SEQ ID NO: 100851 - DNA, 29 bp, Artificial Sequence
  Synthetic
gctggctaaguaacaccaataaaatguct

SEQ ID NO: 100852 - DNA, 25 bp, Artificial Sequence
  Synthetic
tgcggaagcucgtacttgaaauaat

SEQ ID NO: 100853 - DNA, 29 bp, Artificial Sequence
  Synthetic
aaagttttacauacggctauacgacaaga

SEQ ID NO: 100854 - DNA, 24 bp, Artificial Sequence
  Synthetic
tgaguaaagccaccttctguacct

SEQ ID NO: 100855 - DNA, 24 bp, Artificial Sequence
  Synthetic
gaactctgugagtggttgacucaa

SEQ ID NO: 100856 - DNA, 26 bp, Artificial Sequence
  Synthetic
attgtttccaguctgtgaagttccut

SEQ ID NO: 100857 - DNA, 28 bp, Artificial Sequence
  Synthetic
agccttaatgaauaccagcccaaatuat

SEQ ID NO: 100858 - DNA, 28 bp, Artificial Sequence
  Synthetic
cagaagtcgttucccatcatctaauact

SEQ ID NO: 100859 - DNA, 26 bp, Artificial Sequence
  Synthetic
aggtaatgggaacautgtagguacca

SEQ ID NO: 100860 - DNA, 27 bp, Artificial Sequence
  Synthetic
tccattcugagaaactttgcttuccat

SEQ ID NO: 100861 - DNA, 28 bp, Artificial Sequence
  Synthetic
ggtcttctcuctgataatcatttugcct

SEQ ID NO: 100862 - DNA, 28 bp, Artificial Sequence
  Synthetic
tggaagagatacaaugatgcacaatuct

SEQ ID NO: 100863 - DNA, 24 bp, Artificial Sequence
  Synthetic
ccccuttgaatgtatuggaacagg

SEQ ID NO: 100864 - DNA, 21 bp, Artificial Sequence
  Synthetic
agggctgugtttgtcagtugt

SEQ ID NO: 100865 - DNA, 22 bp, Artificial Sequence
  Synthetic
caaacgtgcucaccaacttcut

SEQ ID NO: 100866 - DNA, 22 bp, Artificial Sequence
  Synthetic
cccccacacuctcaattttgug

SEQ ID NO: 100867 - DNA, 21 bp, Artificial Sequence
  Synthetic
cgtgaacuggcctttcagcut

SEQ ID NO: 100868 - DNA, 23 bp, Artificial Sequence
  Synthetic
ccactgcccugagaatcttttuc

SEQ ID NO: 100869 - DNA, 26 bp, Artificial Sequence
  Synthetic
gtgttggttugtttggaatctucaca

SEQ ID NO: 100870 - DNA, 21 bp, Artificial Sequence
  Synthetic
gatgtaccccugcagcugaat

SEQ ID NO: 100871 - DNA, 26 bp, Artificial Sequence
  Synthetic
ggctgaagauggactcaaagaattug

SEQ ID NO: 100872 - DNA, 22 bp, Artificial Sequence
  Synthetic
tgcacaagacccugtcttucag

SEQ ID NO: 100873 - DNA, 26 bp, Artificial Sequence
  Synthetic
aaggatccaaucagcttcaacacuaa

SEQ ID NO: 100874 - DNA, 23 bp, Artificial Sequence
  Synthetic
gggtgtggugaaggattctccua

SEQ ID NO: 100875 - DNA, 24 bp, Artificial Sequence
  Synthetic
actacattccaagucctccacuca

SEQ ID NO: 100876 - DNA, 27 bp, Artificial Sequence
  Synthetic
gcctctttaautcaatgattccugcat

SEQ ID NO: 100877 - DNA, 26 bp, Artificial Sequence
  Synthetic
augttttacauggagaggaggaacac

SEQ ID NO: 100878 - DNA, 27 bp, Artificial Sequence
  Synthetic
ttttggaaaaguagcatgtctugacac

SEQ ID NO: 100879 - DNA, 21 bp, Artificial Sequence
  Synthetic
gcgtgagccutgaggagacua

SEQ ID NO: 100880 - DNA, 26 bp, Artificial Sequence
  Synthetic
agtgatcttttucctgtttgacacut

SEQ ID NO: 100881 - DNA, 19 bp, Artificial Sequence
  Synthetic
ggcagauggccaggtaucc

SEQ ID NO: 100882 - DNA, 21 bp, Artificial Sequence
  Synthetic
ggcctggaaggugaacatgua

SEQ ID NO: 100883 - DNA, 19 bp, Artificial Sequence
  Synthetic
gcacgcaccuguaggagag

SEQ ID NO: 100884 - DNA, 25 bp, Artificial Sequence
  Synthetic
gtgttgcttucactctgttttucgt

SEQ ID NO: 100885 - DNA, 22 bp, Artificial Sequence
  Synthetic
gcauaaagacggagaucagcct

SEQ ID NO: 100886 - DNA, 27 bp, Artificial Sequence
  Synthetic
cgtctcttcccugttttaggttttuca

SEQ ID NO: 100887 - DNA, 21 bp, Artificial Sequence
  Synthetic
cccctccuccacaatgatcut

SEQ ID NO: 100888 - DNA, 25 bp, Artificial Sequence
  Synthetic
gtgtgttttuaagccggatucagat

SEQ ID NO: 100889 - DNA, 23 bp, Artificial Sequence
  Synthetic
cccauacagaggcacatgatcut

SEQ ID NO: 100890 - DNA, 19 bp, Artificial Sequence
  Synthetic
gtagtgucccacgugcaca

SEQ ID NO: 100891 - DNA, 25 bp, Artificial Sequence
  Synthetic
gacaagcagaaggaguttcatcuct

SEQ ID NO: 100892 - DNA, 20 bp, Artificial Sequence
  Synthetic
cagatgcugacccacuggac

SEQ ID NO: 100893 - DNA, 26 bp, Artificial Sequence
  Synthetic
gtaaaggtucaaagtgaatgccugaa

SEQ ID NO: 100894 - DNA, 22 bp, Artificial Sequence
  Synthetic
gcaacaaccccagcuacauaga

SEQ ID NO: 100895 - DNA, 24 bp, Artificial Sequence
  Synthetic
tgtucaacagagtcugaggaaagg

SEQ ID NO: 100896 - DNA, 23 bp, Artificial Sequence
  Synthetic
attttggugacccaugggagaat

SEQ ID NO: 100897 - DNA, 20 bp, Artificial Sequence
  Synthetic
gctcgatutgtgccgucagt

SEQ ID NO: 100898 - DNA, 23 bp, Artificial Sequence
  Synthetic
ccttugcaagcacaggttgtuag

SEQ ID NO: 100899 - DNA, 28 bp, Artificial Sequence
  Synthetic
ccgtgaacaccauaatagaaaaggugaa

SEQ ID NO: 100900 - DNA, 22 bp, Artificial Sequence
  Synthetic
caacccaaucccacacgactua

SEQ ID NO: 100901 - DNA, 19 bp, Artificial Sequence
  Synthetic
cagcgaucaucgaggagga

SEQ ID NO: 100902 - DNA, 27 bp, Artificial Sequence
  Synthetic
ggcgattccuccttctttgttaactua

SEQ ID NO: 100903 - DNA, 29 bp, Artificial Sequence
  Synthetic
aggtcttatgtcugtgttgctctctauat

SEQ ID NO: 100904 - DNA, 29 bp, Artificial Sequence
  Synthetic
gtgctctatttuaagtatgcagctgauct

SEQ ID NO: 100905 - DNA, 21 bp, Artificial Sequence
  Synthetic
agtuggccacacggatgtaug

SEQ ID NO: 100906 - DNA, 22 bp, Artificial Sequence
  Synthetic
tgaagggaccaaaugccaacut

SEQ ID NO: 100907 - DNA, 21 bp, Artificial Sequence
  Synthetic
tcatcgatguctggcacacug

SEQ ID NO: 100908 - DNA, 20 bp, Artificial Sequence
  Synthetic
accgucggagctcatcuagt

SEQ ID NO: 100909 - DNA, 28 bp, Artificial Sequence
  Synthetic
gcaacaacaauagcaaaatcacaugaga

SEQ ID NO: 100910 - DNA, 24 bp, Artificial Sequence
  Synthetic
tccagauagcaggaaauggacaga

SEQ ID NO: 100911 - DNA, 24 bp, Artificial Sequence
  Synthetic
tctccaccatauaagggaccguag

SEQ ID NO: 100912 - DNA, 25 bp, Artificial Sequence
  Synthetic
tccaaactacggucccttatauggt

SEQ ID NO: 100913 - DNA, 28 bp, Artificial Sequence
  Synthetic
gctataagcacauccttggctacatuat

SEQ ID NO: 100914 - DNA, 20 bp, Artificial Sequence
  Synthetic
cgaguggtccugaggacaga

SEQ ID NO: 100915 - DNA, 17 bp, Artificial Sequence
  Synthetic
gcggcuccgagaugacc

SEQ ID NO: 100916 - DNA, 25 bp, Artificial Sequence
  Synthetic
cctgcaaagaugattttgaccauga

SEQ ID NO: 100917 - DNA, 21 bp, Artificial Sequence
  Synthetic
ttacccugatggcguacaacc

SEQ ID NO: 100918 - DNA, 17 bp, Artificial Sequence
  Synthetic
caggcgggugacgtuga

SEQ ID NO: 100919 - DNA, 20 bp, Artificial Sequence
  Synthetic
ccacaacccutgtcccugag

SEQ ID NO: 100920 - DNA, 25 bp, Artificial Sequence
  Synthetic
ggacatcccaaaaugaccctaacug

SEQ ID NO: 100921 - DNA, 28 bp, Artificial Sequence
  Synthetic
ccatgtatgcaucagtctcttaggauct

SEQ ID NO: 100922 - DNA, 32 bp, Artificial Sequence
  Synthetic
aataaggctgtgauataaatagtgtguaaagt

SEQ ID NO: 100923 - DNA, 26 bp, Artificial Sequence
  Synthetic
caggaaaggagcutacagaaattugg

SEQ ID NO: 100924 - DNA, 28 bp, Artificial Sequence
  Synthetic
ggtgggtgacacucttttaataatuggt

SEQ ID NO: 100925 - DNA, 28 bp, Artificial Sequence
  Synthetic
agatcctgttatgucatctatgggtcut

SEQ ID NO: 100926 - DNA, 26 bp, Artificial Sequence
  Synthetic
gttgatcttaatugttgcctgtggut

SEQ ID NO: 100927 - DNA, 22 bp, Artificial Sequence
  Synthetic
ttacaucaccaacgcagtccut

SEQ ID NO: 100928 - DNA, 22 bp, Artificial Sequence
  Synthetic
gtgtgtgtauctgagtgccuga

SEQ ID NO: 100929 - DNA, 27 bp, Artificial Sequence
  Synthetic
agauggacggattcauggaaagaaaat

SEQ ID NO: 100930 - DNA, 23 bp, Artificial Sequence
  Synthetic
aaacgtagucgtctcugcaacaa

SEQ ID NO: 100931 - DNA, 23 bp, Artificial Sequence
  Synthetic
gctgacugcagcattcaguaaaa

SEQ ID NO: 100932 - DNA, 27 bp, Artificial Sequence
  Synthetic
cataagacaaucgctaaggttacuggt

SEQ ID NO: 100933 - DNA, 20 bp, Artificial Sequence
  Synthetic
catccgcaucccaggagtuc

SEQ ID NO: 100934 - DNA, 25 bp, Artificial Sequence
  Synthetic
tcgagacacggutccctaattauct

SEQ ID NO: 100935 - DNA, 23 bp, Artificial Sequence
  Synthetic
gcctctctuggaagttctcacuc

SEQ ID NO: 100936 - DNA, 17 bp, Artificial Sequence
  Synthetic
ttgcgacgugtgugggt

SEQ ID NO: 100937 - DNA, 20 bp, Artificial Sequence
  Synthetic
ggcugagctttugggacaga

SEQ ID NO: 100938 - DNA, 20 bp, Artificial Sequence
  Synthetic
ggctccaaucccggttcaua

SEQ ID NO: 100939 - DNA, 24 bp, Artificial Sequence
  Synthetic
tcaatactgugctttgcacucaca

SEQ ID NO: 100940 - DNA, 18 bp, Artificial Sequence
  Synthetic
gcctgccccguttctcut

SEQ ID NO: 100941 - DNA, 22 bp, Artificial Sequence
  Synthetic
ccggtcataguaacgggagaug

SEQ ID NO: 100942 - DNA, 19 bp, Artificial Sequence
  Synthetic
ggcaucgagcaugacaacc

SEQ ID NO: 100943 - DNA, 23 bp, Artificial Sequence
  Synthetic
tcatctccuaaacacccctguct

SEQ ID NO: 100944 - DNA, 26 bp, Artificial Sequence
  Synthetic
aaccctttuacggagtctttcatcuc

SEQ ID NO: 100945 - DNA, 24 bp, Artificial Sequence
  Synthetic
agaagggugaagctctttuggaac

SEQ ID NO: 100946 - DNA, 22 bp, Artificial Sequence
  Synthetic
tttaaagugacgtccugcacca

SEQ ID NO: 100947 - DNA, 27 bp, Artificial Sequence
  Synthetic
gtaugtattcatcttguccacggagat

SEQ ID NO: 100948 - DNA, 32 bp, Artificial Sequence
  Synthetic
aaagacttttcucattaatgtaattugaagca

SEQ ID NO: 100949 - DNA, 24 bp, Artificial Sequence
  Synthetic
agattugacaagagcacagauggt

SEQ ID NO: 100950 - DNA, 21 bp, Artificial Sequence
  Synthetic
ctatcucaaacacgcaugcct

SEQ ID NO: 100951 - DNA, 28 bp, Artificial Sequence
  Synthetic
acaattccatgtuctccagaagcatuaa

SEQ ID NO: 100952 - DNA, 24 bp, Artificial Sequence
  Synthetic
ggctctaggaauttgaagccuaca

SEQ ID NO: 100953 - DNA, 23 bp, Artificial Sequence
  Synthetic
atttugcccaaagcaucagcaat

SEQ ID NO: 100954 - DNA, 26 bp, Artificial Sequence
  Synthetic
aaatuccagagaagaaagctauggca

SEQ ID NO: 100955 - DNA, 27 bp, Artificial Sequence
  Synthetic
gagaattaatcuggaagctggaaguct

SEQ ID NO: 100956 - DNA, 21 bp, Artificial Sequence
  Synthetic
ctgatccttuggtggcacuga

SEQ ID NO: 100957 - DNA, 21 bp, Artificial Sequence
  Synthetic
ctgctgaagcutgtgtctugg

SEQ ID NO: 100958 - DNA, 22 bp, Artificial Sequence
  Synthetic
gcatcgcccugctttcattcua

SEQ ID NO: 100959 - DNA, 21 bp, Artificial Sequence
  Synthetic
cacgatctcutcggctctcuc

SEQ ID NO: 100960 - DNA, 21 bp, Artificial Sequence
  Synthetic
gugcgcaacgccttuaaaaga

SEQ ID NO: 100961 - DNA, 22 bp, Artificial Sequence
  Synthetic
ctgcttccucacagtggagtut

SEQ ID NO: 100962 - DNA, 21 bp, Artificial Sequence
  Synthetic
ggttcgagaagucacctcucc

SEQ ID NO: 100963 - DNA, 26 bp, Artificial Sequence
  Synthetic
ttgaaattaccutggttctggugaca

SEQ ID NO: 100964 - DNA, 20 bp, Artificial Sequence
  Synthetic
gcctgaucccaagucgaaca

SEQ ID NO: 100965 - DNA, 23 bp, Artificial Sequence
  Synthetic
gagtggaaaucctcactgtccuc

SEQ ID NO: 100966 - DNA, 20 bp, Artificial Sequence
  Synthetic
tccaccugucagaggacgag

SEQ ID NO: 100967 - DNA, 21 bp, Artificial Sequence
  Synthetic
tgaaccaccuaggcuggagaa

SEQ ID NO: 100968 - DNA, 22 bp, Artificial Sequence
  Synthetic
gttcctcccuctgaatcugcaa

SEQ ID NO: 100969 - DNA, 18 bp, Artificial Sequence
  Synthetic
ccaccccuctgtggucat

SEQ ID NO: 100970 - DNA, 27 bp, Artificial Sequence
  Synthetic
tttgccttactguttaggaatgaccut

SEQ ID NO: 100971 - DNA, 27 bp, Artificial Sequence
  Synthetic
gtcatcatctucacaagcaaaauggac

SEQ ID NO: 100972 - DNA, 20 bp, Artificial Sequence
  Synthetic
ggacccacuggatcctuacc

SEQ ID NO: 100973 - DNA, 26 bp, Artificial Sequence
  Synthetic
gcttcttugaattccaagugcaagat

SEQ ID NO: 100974 - DNA, 20 bp, Artificial Sequence
  Synthetic
acaccuacacuccgggagaa

SEQ ID NO: 100975 - DNA, 26 bp, Artificial Sequence
  Synthetic
gggagcacatuaaggaccaatataug

SEQ ID NO: 100976 - DNA, 21 bp, Artificial Sequence
  Synthetic
gtgcttggcuttcatcgucag

SEQ ID NO: 100977 - DNA, 23 bp, Artificial Sequence
  Synthetic
ctgcaggaagaugaacgctacua

SEQ ID NO: 100978 - DNA, 29 bp, Artificial Sequence
  Synthetic
acctttacctcuagtgacaaatctctuga

SEQ ID NO: 100979 - DNA, 25 bp, Artificial Sequence
  Synthetic
attccattcugcctgataagcaugt

SEQ ID NO: 100980 - DNA, 21 bp, Artificial Sequence
  Synthetic
atgcugcagacgaactgtuct

SEQ ID NO: 100981 - DNA, 25 bp, Artificial Sequence
  Synthetic
cgutttcagauacagcaaaccgaaa

SEQ ID NO: 100982 - DNA, 24 bp, Artificial Sequence
  Synthetic
tgggagtttugctgcgaatgauat

SEQ ID NO: 100983 - DNA, 27 bp, Artificial Sequence
  Synthetic
tgtccagtaaagautcttatggtugcc

SEQ ID NO: 100984 - DNA, 22 bp, Artificial Sequence
  Synthetic
ctggttgaacucatggaccuga

SEQ ID NO: 100985 - DNA, 26 bp, Artificial Sequence
  Synthetic
aaaggatcaacucacgtgtatucaca

SEQ ID NO: 100986 - DNA, 29 bp, Artificial Sequence
  Synthetic
ggaaacaattugacaagtatgaucacaca

SEQ ID NO: 100987 - DNA, 28 bp, Artificial Sequence
  Synthetic
ctgcacttatucctctttgctttuacag

SEQ ID NO: 100988 - DNA, 21 bp, Artificial Sequence
  Synthetic
cagctgtcugcatgagaccua

SEQ ID NO: 100989 - DNA, 22 bp, Artificial Sequence
  Synthetic
cugaaaguaagcaggagccagt

SEQ ID NO: 100990 - DNA, 28 bp, Artificial Sequence
  Synthetic
ctgacattaagugttctacgagauccat

SEQ ID NO: 100991 - DNA, 22 bp, Artificial Sequence
  Synthetic
catcagcuggagctcgagatuc

SEQ ID NO: 100992 - DNA, 21 bp, Artificial Sequence
  Synthetic
gatcccgucctgtccgaauaa

SEQ ID NO: 100993 - DNA, 24 bp, Artificial Sequence
  Synthetic
ctccaatattuagaagccgcugga

SEQ ID NO: 100994 - DNA, 22 bp, Artificial Sequence
  Synthetic
gcagcacaguctaacucaaggg

SEQ ID NO: 100995 - DNA, 22 bp, Artificial Sequence
  Synthetic
atgaaagcagcaaucgcctcua

SEQ ID NO: 100996 - DNA, 21 bp, Artificial Sequence
  Synthetic
ctcctcttugctggcagauca

SEQ ID NO: 100997 - DNA, 26 bp, Artificial Sequence
  Synthetic
cctggacacuatctaaaacctugcag

SEQ ID NO: 100998 - DNA, 26 bp, Artificial Sequence
  Synthetic
ttcacagcaaagaagaguactugaaa

SEQ ID NO: 100999 - DNA, 20 bp, Artificial Sequence
  Synthetic
agcaaaguggcacaatucgg

SEQ ID NO: 101000 - DNA, 23 bp, Artificial Sequence
  Synthetic
aggcaatgagugaaacaguccag

SEQ ID NO: 101001 - DNA, 27 bp, Artificial Sequence
  Synthetic
tcattctgtctutcgtttctccucaag

SEQ ID NO: 101002 - DNA, 23 bp, Artificial Sequence
  Synthetic
gcgataatcaugtccccaaugga

SEQ ID NO: 101003 - DNA, 21 bp, Artificial Sequence
  Synthetic
tgttcctucccaggttggtug

SEQ ID NO: 101004 - DNA, 22 bp, Artificial Sequence
  Synthetic
gagaaguccagatgcccugaat

SEQ ID NO: 101005 - DNA, 21 bp, Artificial Sequence
  Synthetic
gctaucggccaggttgaugac

SEQ ID NO: 101006 - DNA, 28 bp, Artificial Sequence
  Synthetic
ttaactttagttcacaucagcactgcua

SEQ ID NO: 101007 - DNA, 26 bp, Artificial Sequence
  Synthetic
cagtggttggutaatgcaaaaaucac

SEQ ID NO: 101008 - DNA, 24 bp, Artificial Sequence
  Synthetic
gtactgcuaaagaagcagcttugg

SEQ ID NO: 101009 - DNA, 25 bp, Artificial Sequence
  Synthetic
cggatttgtuaacatgctcccaaut

SEQ ID NO: 101010 - DNA, 21 bp, Artificial Sequence
  Synthetic
gcacaaaucaacgcaggctua

SEQ ID NO: 101011 - DNA, 20 bp, Artificial Sequence
  Synthetic
ccctgguaatgatgcugcct

SEQ ID NO: 101012 - DNA, 19 bp, Artificial Sequence
  Synthetic
gctcccguccaucaccaac

SEQ ID NO: 101013 - DNA, 19 bp, Artificial Sequence
  Synthetic
gcctcaccucctcttugga

SEQ ID NO: 101014 - DNA, 26 bp, Artificial Sequence
  Synthetic
gaggtataucaaaacacttggcggua

SEQ ID NO: 101015 - DNA, 28 bp, Artificial Sequence
  Synthetic
ccattaaattttugcgtcacctttucag

SEQ ID NO: 101016 - DNA, 23 bp, Artificial Sequence
  Synthetic
ctttccauacagctagcctguga

SEQ ID NO: 101017 - DNA, 28 bp, Artificial Sequence
  Synthetic
cagatgccatgutttctgaagacatuag

SEQ ID NO: 101018 - DNA, 22 bp, Artificial Sequence
  Synthetic
ttctgtttucccaagcctguca

SEQ ID NO: 101019 - DNA, 25 bp, Artificial Sequence
  Synthetic
ccagctagaacuccaggatcuacag

SEQ ID NO: 101020 - DNA, 27 bp, Artificial Sequence
  Synthetic
cgacgaaaagaaggguaaccaaaauag

SEQ ID NO: 101021 - DNA, 28 bp, Artificial Sequence
  Synthetic
gctgcagtgaugtttgtttctgtttaua

SEQ ID NO: 101022 - DNA, 24 bp, Artificial Sequence
  Synthetic
ctcttggatggcuctgtatcgtuc

SEQ ID NO: 101023 - DNA, 27 bp, Artificial Sequence
  Synthetic
tgcatgaauggccactttatttttcut

SEQ ID NO: 101024 - DNA, 28 bp, Artificial Sequence
  Synthetic
gaacaagccaagagcuattttcttucaa

SEQ ID NO: 101025 - DNA, 23 bp, Artificial Sequence
  Synthetic
tucggugaaaaccacagcaaaag

SEQ ID NO: 101026 - DNA, 24 bp, Artificial Sequence
  Synthetic
ccgtttgcuctgtttgttgaaugt

SEQ ID NO: 101027 - DNA, 26 bp, Artificial Sequence
  Synthetic
tttcactctgauaactgcctttucca

SEQ ID NO: 101028 - DNA, 29 bp, Artificial Sequence
  Synthetic
tcttcctataacgaaagugtctgctttut

SEQ ID NO: 101029 - DNA, 26 bp, Artificial Sequence
  Synthetic
gcaacccaacugttctaaagtcttut

SEQ ID NO: 101030 - DNA, 28 bp, Artificial Sequence
  Synthetic
tgtggaauaaagttgcuagaacaaaaag

SEQ ID NO: 101031 - DNA, 24 bp, Artificial Sequence
  Synthetic
attctgagtguggaaatggctuca

SEQ ID NO: 101032 - DNA, 28 bp, Artificial Sequence
  Synthetic
tgcactcacacauatagaaaccatgaut

SEQ ID NO: 101033 - DNA, 28 bp, Artificial Sequence
  Synthetic
aatctagagugtatccaaaaugccaaca

SEQ ID NO: 101034 - DNA, 28 bp, Artificial Sequence
  Synthetic
ggatgccttacuttttctttttggauga

SEQ ID NO: 101035 - DNA, 28 bp, Artificial Sequence
  Synthetic
acaaatatacaccuggacguagagaaga

SEQ ID NO: 101036 - DNA, 27 bp, Artificial Sequence
  Synthetic
gccattuccacactcagaauaacaaaa

SEQ ID NO: 101037 - DNA, 29 bp, Artificial Sequence
  Synthetic
tctactaggtacacuagtgaaagaacucc

SEQ ID NO: 101038 - DNA, 23 bp, Artificial Sequence
  Synthetic
gtacttacttgugtgggtgccut

SEQ ID NO: 101039 - DNA, 27 bp, Artificial Sequence
  Synthetic
ggctgtacacagaguaaaagtcacaut

SEQ ID NO: 101040 - DNA, 28 bp, Artificial Sequence
  Synthetic
ctatatccccaaguaaaactgacuccaa

SEQ ID NO: 101041 - DNA, 27 bp, Artificial Sequence
  Synthetic
cagaagtuagctaaagaccucacaact

SEQ ID NO: 101042 - DNA, 21 bp, Artificial Sequence
  Synthetic
ccctctccuggctcatcctua

SEQ ID NO: 101043 - DNA, 27 bp, Artificial Sequence
  Synthetic
tgttttaataggutgatcgggaucgag

SEQ ID NO: 101044 - DNA, 27 bp, Artificial Sequence
  Synthetic
tgtcttcgcuttcagcttagtuagaat

SEQ ID NO: 101045 - DNA, 28 bp, Artificial Sequence
  Synthetic
ggcttgttttgcugttcttactgattut

SEQ ID NO: 101046 - DNA, 22 bp, Artificial Sequence
  Synthetic
gatgcagcautcccacatgtut

SEQ ID NO: 101047 - DNA, 21 bp, Artificial Sequence
  Synthetic
ccagctgcucacagctctuac

SEQ ID NO: 101048 - DNA, 23 bp, Artificial Sequence
  Synthetic
gggtttcucttccttgtugcagt

SEQ ID NO: 101049 - DNA, 23 bp, Artificial Sequence
  Synthetic
ccatcttcagautctgcctgugt

SEQ ID NO: 101050 - DNA, 23 bp, Artificial Sequence
  Synthetic
gggaaaacaagguagctccugaa

SEQ ID NO: 101051 - DNA, 26 bp, Artificial Sequence
  Synthetic
atacaaggactacuccaaacagtgug

SEQ ID NO: 101052 - DNA, 24 bp, Artificial Sequence
  Synthetic
ctacaaacaaaagugccactguga

SEQ ID NO: 101053 - DNA, 24 bp, Artificial Sequence
  Synthetic
gcaaaaacuggcaaatgtgttuga

SEQ ID NO: 101054 - DNA, 25 bp, Artificial Sequence
  Synthetic
agcttgguatttctttcucagcagt

SEQ ID NO: 101055 - DNA, 24 bp, Artificial Sequence
  Synthetic
ccctgtctugtccgaatgaucaag

SEQ ID NO: 101056 - DNA, 20 bp, Artificial Sequence
  Synthetic
tttgttctgcuacgggcugt

SEQ ID NO: 101057 - DNA, 22 bp, Artificial Sequence
  Synthetic
tgagtttucccgttgcttucct

SEQ ID NO: 101058 - DNA, 25 bp, Artificial Sequence
  Synthetic
gaacaaccttttucgtgctccaaut

SEQ ID NO: 101059 - DNA, 24 bp, Artificial Sequence
  Synthetic
cgtattggcccutttggagtuagg

SEQ ID NO: 101060 - DNA, 20 bp, Artificial Sequence
  Synthetic
agaugggaccucaggaagca

SEQ ID NO: 101061 - DNA, 23 bp, Artificial Sequence
  Synthetic
tgcaatcugagcattcuccacag

SEQ ID NO: 101062 - DNA, 20 bp, Artificial Sequence
  Synthetic
ctgctgcugaactgucgaag

SEQ ID NO: 101063 - DNA, 28 bp, Artificial Sequence
  Synthetic
tgctcatgagugttggttattattucca

SEQ ID NO: 101064 - DNA, 24 bp, Artificial Sequence
  Synthetic
cagtgtcccutgtttgaagtucct

SEQ ID NO: 101065 - DNA, 21 bp, Artificial Sequence
  Synthetic
ggccccaacauaccctttcug

SEQ ID NO: 101066 - DNA, 23 bp, Artificial Sequence
  Synthetic
acagcctcuccccataattccut

SEQ ID NO: 101067 - DNA, 19 bp, Artificial Sequence
  Synthetic
gccaaugugcagaccacct

SEQ ID NO: 101068 - DNA, 22 bp, Artificial Sequence
  Synthetic
acaaggaacuggtgucaaagca

SEQ ID NO: 101069 - DNA, 28 bp, Artificial Sequence
  Synthetic
gggattcctaaagutggtgtcttaaugg

SEQ ID NO: 101070 - DNA, 26 bp, Artificial Sequence
  Synthetic
tcgatacagcagcaguatgtcaauat

SEQ ID NO: 101071 - DNA, 24 bp, Artificial Sequence
  Synthetic
tccagcagcugtgaaattgactua

SEQ ID NO: 101072 - DNA, 22 bp, Artificial Sequence
  Synthetic
tgttggtgucacacagcctaut

SEQ ID NO: 101073 - DNA, 29 bp, Artificial Sequence
  Synthetic
tgatggatgcccaauacaagataatuaca

SEQ ID NO: 101074 - DNA, 27 bp, Artificial Sequence
  Synthetic
agctgtcatucatattccaaacugact

SEQ ID NO: 101075 - DNA, 26 bp, Artificial Sequence
  Synthetic
ttgatggtggutttcttttgttugct

SEQ ID NO: 101076 - DNA, 25 bp, Artificial Sequence
  Synthetic
tgcacgttttguttaagtttcgcut

SEQ ID NO: 101077 - DNA, 23 bp, Artificial Sequence
  Synthetic
tggtttcactuttgcaggcaaug

SEQ ID NO: 101078 - DNA, 28 bp, Artificial Sequence
  Synthetic
tcatacctgtaaguttactgcatctugg

SEQ ID NO: 101079 - DNA, 21 bp, Artificial Sequence
  Synthetic
aacgccagcagutaccuaaca

SEQ ID NO: 101080 - DNA, 22 bp, Artificial Sequence
  Synthetic
ggttaacccauctgacgtucaa

SEQ ID NO: 101081 - DNA, 26 bp, Artificial Sequence
  Synthetic
tctctgcctauatcagtgctgaugat

SEQ ID NO: 101082 - DNA, 24 bp, Artificial Sequence
  Synthetic
tttggtaatgaggugtgctgtcut

SEQ ID NO: 101083 - DNA, 29 bp, Artificial Sequence
  Synthetic
cggaagttaagaggaaaugtgtcatguat

SEQ ID NO: 101084 - DNA, 26 bp, Artificial Sequence
  Synthetic
caaattagcatucagcagttgucagt

SEQ ID NO: 101085 - DNA, 21 bp, Artificial Sequence
  Synthetic
ctgcaaagcaugtggttcugg

SEQ ID NO: 101086 - DNA, 21 bp, Artificial Sequence
  Synthetic
cctggcuaaactgctugcaga

SEQ ID NO: 101087 - DNA, 24 bp, Artificial Sequence
  Synthetic
gctcattguggttgtccttttucc

SEQ ID NO: 101088 - DNA, 23 bp, Artificial Sequence
  Synthetic
cattcagacugagagcacucaca

SEQ ID NO: 101089 - DNA, 23 bp, Artificial Sequence
  Synthetic
gactctccauggtttctcucagg

SEQ ID NO: 101090 - DNA, 22 bp, Artificial Sequence
  Synthetic
gugtgttagaacuggcccagat

SEQ ID NO: 101091 - DNA, 28 bp, Artificial Sequence
  Synthetic
cctccaagattutgatccacttttucaa

SEQ ID NO: 101092 - DNA, 27 bp, Artificial Sequence
  Synthetic
ctctacgcgutcattaagaauggagat

SEQ ID NO: 101093 - DNA, 26 bp, Artificial Sequence
  Synthetic
gtccgtggguattcaagtttgtttut

SEQ ID NO: 101094 - DNA, 21 bp, Artificial Sequence
  Synthetic
agcctgccuagagtcucagaa

SEQ ID NO: 101095 - DNA, 28 bp, Artificial Sequence
  Synthetic
gttggtctucaaaaatttacctctugct

SEQ ID NO: 101096 - DNA, 21 bp, Artificial Sequence
  Synthetic
agcgtuccaggatccaugaag

SEQ ID NO: 101097 - DNA, 21 bp, Artificial Sequence
  Synthetic
tctgugccgagaaattgcuca

SEQ ID NO: 101098 - DNA, 21 bp, Artificial Sequence
  Synthetic
tctgtccugaatggcctucac

SEQ ID NO: 101099 - DNA, 25 bp, Artificial Sequence
  Synthetic
gccaccagaaccuacttagaaugac

SEQ ID NO: 101100 - DNA, 21 bp, Artificial Sequence
  Synthetic
gcagcuccggagtttctctut

SEQ ID NO: 101101 - DNA, 26 bp, Artificial Sequence
  Synthetic
agagagtctcutgataagcttuccca

SEQ ID NO: 101102 - DNA, 23 bp, Artificial Sequence
  Synthetic
catagaggaaaagugccggtuct

SEQ ID NO: 101103 - DNA, 20 bp, Artificial Sequence
  Synthetic
ccgtgggtuagttccaccug

SEQ ID NO: 101104 - DNA, 28 bp, Artificial Sequence
  Synthetic
cttttgccugcaaccatatttcttuagt

SEQ ID NO: 101105 - DNA, 28 bp, Artificial Sequence
  Synthetic
catgttctcaaugttctttcccattuct

SEQ ID NO: 101106 - DNA, 21 bp, Artificial Sequence
  Synthetic
cgtggccutcttcacucagaa

SEQ ID NO: 101107 - DNA, 22 bp, Artificial Sequence
  Synthetic
gctatgagccugtgtctggtua

SEQ ID NO: 101108 - DNA, 25 bp, Artificial Sequence
  Synthetic
gggtttucatgtaaatcuggacagt

SEQ ID NO: 101109 - DNA, 22 bp, Artificial Sequence
  Synthetic
cgtgctacaaaucagcagucag

SEQ ID NO: 101110 - DNA, 25 bp, Artificial Sequence
  Synthetic
gctcagcugaagatagtgacttuga

SEQ ID NO: 101111 - DNA, 22 bp, Artificial Sequence
  Synthetic
tctgugaagccaagatccucac

SEQ ID NO: 101112 - DNA, 28 bp, Artificial Sequence
  Synthetic
tcttatcactacgcutactttccacauc

SEQ ID NO: 101113 - DNA, 27 bp, Artificial Sequence
  Synthetic
ccaactccuggaaaactaaugagacat

SEQ ID NO: 101114 - DNA, 27 bp, Artificial Sequence
  Synthetic
tgagcgaaatagutacagtgacttucc

SEQ ID NO: 101115 - DNA, 22 bp, Artificial Sequence
  Synthetic
gctgutcgaaagcuccacaaac

SEQ ID NO: 101116 - DNA, 22 bp, Artificial Sequence
  Synthetic
tcugcagttugagggacaagac

SEQ ID NO: 101117 - DNA, 28 bp, Artificial Sequence
  Synthetic
aaatagcaautgcatcaaugagaaccaa

SEQ ID NO: 101118 - DNA, 23 bp, Artificial Sequence
  Synthetic
cccggcaaautgtccttaactut

SEQ ID NO: 101119 - DNA, 22 bp, Artificial Sequence
  Synthetic
acgccactuggtcatcatcauc

SEQ ID NO: 101120 - DNA, 22 bp, Artificial Sequence
  Synthetic
ctgtcctgacucaccttccaut

SEQ ID NO: 101121 - DNA, 21 bp, Artificial Sequence
  Synthetic
cccacttuccccttccatguc

SEQ ID NO: 101122 - DNA, 17 bp, Artificial Sequence
  Synthetic
ggtcccaugcctcugct

SEQ ID NO: 101123 - DNA, 19 bp, Artificial Sequence
  Synthetic
agcctcaccugcctcatug

SEQ ID NO: 101124 - DNA, 17 bp, Artificial Sequence
  Synthetic
gaggcgcaggucctuct

SEQ ID NO: 101125 - DNA, 18 bp, Artificial Sequence
  Synthetic
cccggcugcctucaaaca

SEQ ID NO: 101126 - DNA, 27 bp, Artificial Sequence
  Synthetic
ttggttttgttagugatctgtgcaaug

SEQ ID NO: 101127 - DNA, 26 bp, Artificial Sequence
  Synthetic
ctcctggcatutaaccaaccagauat

SEQ ID NO: 101128 - DNA, 21 bp, Artificial Sequence
  Synthetic
ggcucgaaaggaatggaucct

SEQ ID NO: 101129 - DNA, 23 bp, Artificial Sequence
  Synthetic
agacactccucaacccttcctua

SEQ ID NO: 101130 - DNA, 23 bp, Artificial Sequence
  Synthetic
agaaagctaucaaccccttgcug

SEQ ID NO: 101131 - DNA, 21 bp, Artificial Sequence
  Synthetic
ttttccuttccccugcacgat

SEQ ID NO: 101132 - DNA, 27 bp, Artificial Sequence
  Synthetic
tgatgggtaaagagaaugaggagacut

SEQ ID NO: 101133 - DNA, 27 bp, Artificial Sequence
  Synthetic
aaatggtggagacucagatcaattcug

SEQ ID NO: 101134 - DNA, 24 bp, Artificial Sequence
  Synthetic
tcgtttccugaacccaacattuca

SEQ ID NO: 101135 - DNA, 28 bp, Artificial Sequence
  Synthetic
tcctttcactucacttctgttttauccc

SEQ ID NO: 101136 - DNA, 26 bp, Artificial Sequence
  Synthetic
gcagaccagauataggtcaaccuaag

SEQ ID NO: 101137 - DNA, 21 bp, Artificial Sequence
  Synthetic
acccccugttcatugcaaaca

SEQ ID NO: 101138 - DNA, 28 bp, Artificial Sequence
  Synthetic
tgtctcttcacauttcgcaatcatuaga

SEQ ID NO: 101139 - DNA, 21 bp, Artificial Sequence
  Synthetic
guaaacggaaggugaccacca

SEQ ID NO: 101140 - DNA, 25 bp, Artificial Sequence
  Synthetic
gccttcttagcauttccttggauct

SEQ ID NO: 101141 - DNA, 23 bp, Artificial Sequence
  Synthetic
tgctggcugttaacucacaaaca

SEQ ID NO: 101142 - DNA, 23 bp, Artificial Sequence
  Synthetic
agcccugaagaaaggacucagat

SEQ ID NO: 101143 - DNA, 27 bp, Artificial Sequence
  Synthetic
gaagtggttttugtggaagatgucaag

SEQ ID NO: 101144 - DNA, 23 bp, Artificial Sequence
  Synthetic
caaacctugccaacaggaacaut

SEQ ID NO: 101145 - DNA, 30 bp, Artificial Sequence
  Synthetic
tggtacttaccautttgttgttgtcuaaga

SEQ ID NO: 101146 - DNA, 24 bp, Artificial Sequence
  Synthetic
cttgaagcctutgaccttttggut

SEQ ID NO: 101147 - DNA, 21 bp, Artificial Sequence
  Synthetic
gaaacttgucgtgcctgtugg

SEQ ID NO: 101148 - DNA, 21 bp, Artificial Sequence
  Synthetic
gaaaccagcugcacatgcuaa

SEQ ID NO: 101149 - DNA, 26 bp, Artificial Sequence
  Synthetic
cctgatttaggcuttgaactguccat

SEQ ID NO: 101150 - DNA, 20 bp, Artificial Sequence
  Synthetic
ccggctguaactcggaugaa

SEQ ID NO: 101151 - DNA, 20 bp, Artificial Sequence
  Synthetic
caucagcagcttgucgaacc

SEQ ID NO: 101152 - DNA, 22 bp, Artificial Sequence
  Synthetic
cactagtgtugggtctcaugct

SEQ ID NO: 101153 - DNA, 21 bp, Artificial Sequence
  Synthetic
caagcctucgaggaggttuca

SEQ ID NO: 101154 - DNA, 21 bp, Artificial Sequence
  Synthetic
ccttcggtgutccaccagtut

SEQ ID NO: 101155 - DNA, 28 bp, Artificial Sequence
  Synthetic
cctgcaggattguaggttacttagaaut

SEQ ID NO: 101156 - DNA, 28 bp, Artificial Sequence
  Synthetic
caagtagcacaaauttgcttttggcuaa

SEQ ID NO: 101157 - DNA, 25 bp, Artificial Sequence
  Synthetic
agaatacugaggagatgacgugaca

SEQ ID NO: 101158 - DNA, 26 bp, Artificial Sequence
  Synthetic
ggatttttguacgagaacaugagcaa

SEQ ID NO: 101159 - DNA, 22 bp, Artificial Sequence
  Synthetic
gaagcucauggaagacccagac

SEQ ID NO: 101160 - DNA, 28 bp, Artificial Sequence
  Synthetic
ttttgcacaatuagaatgtcacgtcauc

SEQ ID NO: 101161 - DNA, 27 bp, Artificial Sequence
  Synthetic
gcacccttgtcutctcatgttatttut

SEQ ID NO: 101162 - DNA, 25 bp, Artificial Sequence
  Synthetic
ctcacggagucagttccaatatuca

SEQ ID NO: 101163 - DNA, 24 bp, Artificial Sequence
  Synthetic
ctaactgucagaacagctctgguc

SEQ ID NO: 101164 - DNA, 21 bp, Artificial Sequence
  Synthetic
cccaaguccgaactcaagcug

SEQ ID NO: 101165 - DNA, 24 bp, Artificial Sequence
  Synthetic
cataagggucagagtgauccacaa

SEQ ID NO: 101166 - DNA, 23 bp, Artificial Sequence
  Synthetic
ggagagaagaagggucagcauct

SEQ ID NO: 101167 - DNA, 26 bp, Artificial Sequence
  Synthetic
gaatttgcctauacttccaggtgcua

SEQ ID NO: 101168 - DNA, 27 bp, Artificial Sequence
  Synthetic
caacataggcaccauctactttuagca

SEQ ID NO: 101169 - DNA, 30 bp, Artificial Sequence
  Synthetic
tgatcattgaagaaacauacaaagaatugg

SEQ ID NO: 101170 - DNA, 23 bp, Artificial Sequence
  Synthetic
tgataacacagccutaccuggga

SEQ ID NO: 101171 - DNA, 21 bp, Artificial Sequence
  Synthetic
gctgcctutgtttgccuacag

SEQ ID NO: 101172 - DNA, 24 bp, Artificial Sequence
  Synthetic
cctgctagtguagtccttccacut

SEQ ID NO: 101173 - DNA, 24 bp, Artificial Sequence
  Synthetic
aaaggutacagctcaucgaggaac

SEQ ID NO: 101174 - DNA, 22 bp, Artificial Sequence
  Synthetic
aggactggcugtttttcggtua

SEQ ID NO: 101175 - DNA, 25 bp, Artificial Sequence
  Synthetic
ctcctcacgacaacautctgtttug

SEQ ID NO: 101176 - DNA, 21 bp, Artificial Sequence
  Synthetic
gcacugggagttucacacaga

SEQ ID NO: 101177 - DNA, 27 bp, Artificial Sequence
  Synthetic
gtggcttcucacagggattauaaaaac

SEQ ID NO: 101178 - DNA, 19 bp, Artificial Sequence
  Synthetic
ctgaaggtcuggcggtgut

SEQ ID NO: 101179 - DNA, 28 bp, Artificial Sequence
  Synthetic
gccaaatatagcaugtcagtgttttuga

SEQ ID NO: 101180 - DNA, 19 bp, Artificial Sequence
  Synthetic
cugaggcaaagctcugggt

SEQ ID NO: 101181 - DNA, 17 bp, Artificial Sequence
  Synthetic
gccccugtccccucaag

SEQ ID NO: 101182 - DNA, 17 bp, Artificial Sequence
  Synthetic
ggagcugccaggtggua

SEQ ID NO: 101183 - DNA, 19 bp, Artificial Sequence
  Synthetic
ccacacguccagctgtcuc

SEQ ID NO: 101184 - DNA, 18 bp, Artificial Sequence
  Synthetic
ggtgtccucgagcctuga

SEQ ID NO: 101185 - DNA, 19 bp, Artificial Sequence
  Synthetic
cctccucgggtacccaucc

SEQ ID NO: 101186 - DNA, 18 bp, Artificial Sequence
  Synthetic
ggagacagcuggacgugt

SEQ ID NO: 101187 - DNA, 21 bp, Artificial Sequence
  Synthetic
gagatctuccaggcgcuacag

SEQ ID NO: 101188 - DNA, 20 bp, Artificial Sequence
  Synthetic
cagttgccucatgcacucct

SEQ ID NO: 101189 - DNA, 21 bp, Artificial Sequence
  Synthetic
cagaccaacuacgcctttgug

SEQ ID NO: 101190 - DNA, 19 bp, Artificial Sequence
  Synthetic
gcgggaggaacaggutguc

SEQ ID NO: 101191 - DNA, 22 bp, Artificial Sequence
  Synthetic
agauctgctccaucaacagcac

SEQ ID NO: 101192 - DNA, 20 bp, Artificial Sequence
  Synthetic
tcaggcacaaaggcguagut

SEQ ID NO: 101193 - DNA, 17 bp, Artificial Sequence
  Synthetic
cgcccgccuaugacgac

SEQ ID NO: 101194 - DNA, 29 bp, Artificial Sequence
  Synthetic
gtaaagtgctauggtcatattgtguagga

SEQ ID NO: 101195 - DNA, 22 bp, Artificial Sequence
  Synthetic
aatuggccaggauggagagaac

SEQ ID NO: 101196 - DNA, 26 bp, Artificial Sequence
  Synthetic
tttactgccauacatctcctttccug

SEQ ID NO: 101197 - DNA, 22 bp, Artificial Sequence
  Synthetic
tctgagcugactggttccucat

SEQ ID NO: 101198 - DNA, 24 bp, Artificial Sequence
  Synthetic
ctgtcttctucttttgacccucca

SEQ ID NO: 101199 - DNA, 21 bp, Artificial Sequence
  Synthetic
aagaacagggcacguttcuga

SEQ ID NO: 101200 - DNA, 28 bp, Artificial Sequence
  Synthetic
aggaagagautcccaaaaatuacagcat

SEQ ID NO: 101201 - DNA, 26 bp, Artificial Sequence
  Synthetic
caaagutcccuagaaaaccagaccaa

SEQ ID NO: 101202 - DNA, 21 bp, Artificial Sequence
  Synthetic
caucttcatguggaggcagca

SEQ ID NO: 101203 - DNA, 26 bp, Artificial Sequence
  Synthetic
ctgtcattcccuaccccaaaauagaa

SEQ ID NO: 101204 - DNA, 22 bp, Artificial Sequence
  Synthetic
gggctccgaguttctggatcua

SEQ ID NO: 101205 - DNA, 19 bp, Artificial Sequence
  Synthetic
gtgttcucacaccggugct

SEQ ID NO: 101206 - DNA, 21 bp, Artificial Sequence
  Synthetic
gctattttggcuggcgaagut

SEQ ID NO: 101207 - DNA, 21 bp, Artificial Sequence
  Synthetic
ggaagugggagctagagcuca

SEQ ID NO: 101208 - DNA, 20 bp, Artificial Sequence
  Synthetic
gcauacacgcaacccctcua

SEQ ID NO: 101209 - DNA, 22 bp, Artificial Sequence
  Synthetic
cgttgttgucaagggugaggag

SEQ ID NO: 101210 - DNA, 21 bp, Artificial Sequence
  Synthetic
tggctctcguccagtatcucc

SEQ ID NO: 101211 - DNA, 28 bp, Artificial Sequence
  Synthetic
tggcttattcgaauggctaagatugaat

SEQ ID NO: 101212 - DNA, 21 bp, Artificial Sequence
  Synthetic
cctgctucaaccacaauggag

SEQ ID NO: 101213 - DNA, 27 bp, Artificial Sequence
  Synthetic
tctggtttactcguctagttgactgua

SEQ ID NO: 101214 - DNA, 25 bp, Artificial Sequence
  Synthetic
gcttaagucagctattucccacgaa

SEQ ID NO: 101215 - DNA, 26 bp, Artificial Sequence
  Synthetic
tggaaatcagcuccttcgacuaaaaa

SEQ ID NO: 101216 - DNA, 21 bp, Artificial Sequence
  Synthetic
tttcttgccagcuaccagugt

SEQ ID NO: 101217 - DNA, 22 bp, Artificial Sequence
  Synthetic
tggacagcucaucacaggagat

SEQ ID NO: 101218 - DNA, 20 bp, Artificial Sequence
  Synthetic
ctatcaaugcgcgacagcuc

SEQ ID NO: 101219 - DNA, 26 bp, Artificial Sequence
  Synthetic
accctaattugaacatcgctactugt

SEQ ID NO: 101220 - DNA, 22 bp, Artificial Sequence
  Synthetic
acaaaggacutgcaagccauct

SEQ ID NO: 101221 - DNA, 22 bp, Artificial Sequence
  Synthetic
gcgataaaccutccagggtuca

SEQ ID NO: 101222 - DNA, 26 bp, Artificial Sequence
  Synthetic
acatattaugcacatggttugaggct

SEQ ID NO: 101223 - DNA, 26 bp, Artificial Sequence
  Synthetic
tcccacatcauctctgtcatagucat

SEQ ID NO: 101224 - DNA, 24 bp, Artificial Sequence
  Synthetic
actgtgtcucaagactgcatucaa

SEQ ID NO: 101225 - DNA, 24 bp, Artificial Sequence
  Synthetic
catgtagccucaaacagatggtuc

SEQ ID NO: 101226 - DNA, 27 bp, Artificial Sequence
  Synthetic
gtgtcttuactgtcttgtuaaccccaa

SEQ ID NO: 101227 - DNA, 20 bp, Artificial Sequence
  Synthetic
catcucccgcacucggaaat

SEQ ID NO: 101228 - DNA, 19 bp, Artificial Sequence
  Synthetic
tccuccccatccucaggaa

SEQ ID NO: 101229 - DNA, 28 bp, Artificial Sequence
  Synthetic
ggtaaacttttcutcacattgcaaguca

SEQ ID NO: 101230 - DNA, 28 bp, Artificial Sequence
  Synthetic
catacacaagcautcaccgataaatucc

SEQ ID NO: 101231 - DNA, 22 bp, Artificial Sequence
  Synthetic
gagcacacugctcagactuact

SEQ ID NO: 101232 - DNA, 24 bp, Artificial Sequence
  Synthetic
ctatccgcuctccttgaagtucag

SEQ ID NO: 101233 - DNA, 28 bp, Artificial Sequence
  Synthetic
cacaatcctttugaaaagatggctugat

SEQ ID NO: 101234 - DNA, 20 bp, Artificial Sequence
  Synthetic
ccatctcuggttgcctucgt

SEQ ID NO: 101235 - DNA, 25 bp, Artificial Sequence
  Synthetic
ctgatatgcttcuctgtggcctuag

SEQ ID NO: 101236 - DNA, 24 bp, Artificial Sequence
  Synthetic
cattccatuacaacccagcucagt

SEQ ID NO: 101237 - DNA, 21 bp, Artificial Sequence
  Synthetic
ctctgaucaggcagcacctua

SEQ ID NO: 101238 - DNA, 24 bp, Artificial Sequence
  Synthetic
ctgggacucagattugaacacact

SEQ ID NO: 101239 - DNA, 28 bp, Artificial Sequence
  Synthetic
gagttcttgautatgaaaccttugccaa

SEQ ID NO: 101240 - DNA, 25 bp, Artificial Sequence
  Synthetic
tctctcctcggutccttaatctcug

SEQ ID NO: 101241 - DNA, 28 bp, Artificial Sequence
  Synthetic
agggaaggataauctttagctgtcaugt

SEQ ID NO: 101242 - DNA, 23 bp, Artificial Sequence
  Synthetic
aggccuccaaagcttctaaacuc

SEQ ID NO: 101243 - DNA, 28 bp, Artificial Sequence
  Synthetic
ccacttgccctuttaccagactttatua

SEQ ID NO: 101244 - DNA, 25 bp, Artificial Sequence
  Synthetic
ccttgttgugaagtgcttugaaaga

SEQ ID NO: 101245 - DNA, 21 bp, Artificial Sequence
  Synthetic
tgaugcaugaaccccaagcat

SEQ ID NO: 101246 - DNA, 31 bp, Artificial Sequence
  Synthetic
attaggcttttgucattagaaaaguagagct

SEQ ID NO: 101247 - DNA, 28 bp, Artificial Sequence
  Synthetic
cagcattggttuatgatcagtcttucaa

SEQ ID NO: 101248 - DNA, 24 bp, Artificial Sequence
  Synthetic
catgaucccagttcaaauaacgct

SEQ ID NO: 101249 - DNA, 24 bp, Artificial Sequence
  Synthetic
aatcttcuggaagcaauccacgat

SEQ ID NO: 101250 - DNA, 27 bp, Artificial Sequence
  Synthetic
cggattcatacuattccaactgtucct

SEQ ID NO: 101251 - DNA, 22 bp, Artificial Sequence
  Synthetic
cctggccucattcttcaagugt

SEQ ID NO: 101252 - DNA, 25 bp, Artificial Sequence
  Synthetic
tctucacaaaagagccacaaaucct

SEQ ID NO: 101253 - DNA, 21 bp, Artificial Sequence
  Synthetic
tctgguctggcucacagagat

SEQ ID NO: 101254 - DNA, 27 bp, Artificial Sequence
  Synthetic
tgttcaatattagugagctgcagaucc

SEQ ID NO: 101255 - DNA, 23 bp, Artificial Sequence
  Synthetic
aattcgctgugccatctccauat

SEQ ID NO: 101256 - DNA, 25 bp, Artificial Sequence
  Synthetic
agttcacaacuggaaatgagtccut

SEQ ID NO: 101257 - DNA, 19 bp, Artificial Sequence
  Synthetic
cagcttgcugttgcggtuc

SEQ ID NO: 101258 - DNA, 23 bp, Artificial Sequence
  Synthetic
ccaccacauccaugacaacaaca

SEQ ID NO: 101259 - DNA, 24 bp, Artificial Sequence
  Synthetic
gtgtatggcgaauttggcgauaat

SEQ ID NO: 101260 - DNA, 22 bp, Artificial Sequence
  Synthetic
ccucagacagaggcaguagaac

SEQ ID NO: 101261 - DNA, 26 bp, Artificial Sequence
  Synthetic
ggtaaattgtcacutgaccaagcaut

SEQ ID NO: 101262 - DNA, 20 bp, Artificial Sequence
  Synthetic
agtacagcggacacutgcuc

SEQ ID NO: 101263 - DNA, 21 bp, Artificial Sequence
  Synthetic
gccaagugcaccatgugagat

SEQ ID NO: 101264 - DNA, 27 bp, Artificial Sequence
  Synthetic
gtcactctaucccaagattgtttuacc

SEQ ID NO: 101265 - DNA, 23 bp, Artificial Sequence
  Synthetic
gccatactgutgctgttttucct

SEQ ID NO: 101266 - DNA, 22 bp, Artificial Sequence
  Synthetic
tutggctgaugaaaggcagact

SEQ ID NO: 101267 - DNA, 28 bp, Artificial Sequence
  Synthetic
caaagcatctgagautgaatacaagcug

SEQ ID NO: 101268 - DNA, 19 bp, Artificial Sequence
  Synthetic
accggtcgutgaccttucc

SEQ ID NO: 101269 - DNA, 28 bp, Artificial Sequence
  Synthetic
gctttctgaccuctgtgattgctattua

SEQ ID NO: 101270 - DNA, 25 bp, Artificial Sequence
  Synthetic
ctctgcatgcauctgtcaatgagua

SEQ ID NO: 101271 - DNA, 28 bp, Artificial Sequence
  Synthetic
aattctcagataaaugcaaagcacugac

SEQ ID NO: 101272 - DNA, 24 bp, Artificial Sequence
  Synthetic
tcctggtattcugctatccacugt

SEQ ID NO: 101273 - DNA, 29 bp, Artificial Sequence
  Synthetic
cagagaggtuaagaaaggagattcaugat

SEQ ID NO: 101274 - DNA, 23 bp, Artificial Sequence
  Synthetic
agttccttcaacugctccatgug

SEQ ID NO: 101275 - DNA, 27 bp, Artificial Sequence
  Synthetic
tttgctcctacucactctcttttucag

SEQ ID NO: 101276 - DNA, 28 bp, Artificial Sequence
  Synthetic
gcaatgagaagtutaagaagatgcacut

SEQ ID NO: 101277 - DNA, 26 bp, Artificial Sequence
  Synthetic
tccctttgttuttcatgtcaguccat

SEQ ID NO: 101278 - DNA, 23 bp, Artificial Sequence
  Synthetic
gtactaaccggugatcctctgug

SEQ ID NO: 101279 - DNA, 28 bp, Artificial Sequence
  Synthetic
caggttctaaacugactacctacctcut

SEQ ID NO: 101280 - DNA, 26 bp, Artificial Sequence
  Synthetic
cagtatutggcctgtugaagaagaat

SEQ ID NO: 101281 - DNA, 18 bp, Artificial Sequence
  Synthetic
cccaggcagagcugctuc

SEQ ID NO: 101282 - DNA, 24 bp, Artificial Sequence
  Synthetic
tgttcugacggaggataugggaaa

SEQ ID NO: 101283 - DNA, 21 bp, Artificial Sequence
  Synthetic
ctttttcagaggugggcgaug

SEQ ID NO: 101284 - DNA, 20 bp, Artificial Sequence
  Synthetic
cagaactuggagccguggaa

SEQ ID NO: 101285 - DNA, 21 bp, Artificial Sequence
  Synthetic
tctccutgcttcucgaaggga

SEQ ID NO: 101286 - DNA, 18 bp, Artificial Sequence
  Synthetic
guggaagcagctcugcct

SEQ ID NO: 101287 - DNA, 24 bp, Artificial Sequence
  Synthetic
gtccttttcuccttgcttcucgaa

SEQ ID NO: 101288 - DNA, 20 bp, Artificial Sequence
  Synthetic
ccatcaaacuccggcagtuc

SEQ ID NO: 101289 - DNA, 27 bp, Artificial Sequence
  Synthetic
accagaattcaatuataccttggccut

SEQ ID NO: 101290 - DNA, 17 bp, Artificial Sequence
  Synthetic
ccgtgccuccctucgag

SEQ ID NO: 101291 - DNA, 21 bp, Artificial Sequence
  Synthetic
tgttaugccccacgtgatugt

SEQ ID NO: 101292 - DNA, 21 bp, Artificial Sequence
  Synthetic
accttggugtgtggtgucaag

SEQ ID NO: 101293 - DNA, 26 bp, Artificial Sequence
  Synthetic
aacugagcttcuggaaaagagaaagt

SEQ ID NO: 101294 - DNA, 26 bp, Artificial Sequence
  Synthetic
actggauacttgtctguaggaaaggt

SEQ ID NO: 101295 - DNA, 28 bp, Artificial Sequence
  Synthetic
cgactcttctucagagatgattcctuct

SEQ ID NO: 101296 - DNA, 20 bp, Artificial Sequence
  Synthetic
ctcccccuccaaggagagua

SEQ ID NO: 101297 - DNA, 24 bp, Artificial Sequence
  Synthetic
tcttcuaaacaccaagccccttut

SEQ ID NO: 101298 - DNA, 28 bp, Artificial Sequence
  Synthetic
tggatggattacuttagtcctgagaugt

SEQ ID NO: 101299 - DNA, 21 bp, Artificial Sequence
  Synthetic
ttgaatccuccgccgttctut

SEQ ID NO: 101300 - DNA, 18 bp, Artificial Sequence
  Synthetic
cccatgtuccggcgugat

SEQ ID NO: 101301 - DNA, 23 bp, Artificial Sequence
  Synthetic
cttgaugacgactucagacaggt

SEQ ID NO: 101302 - DNA, 21 bp, Artificial Sequence
  Synthetic
caacaucgggaagagaugcga

SEQ ID NO: 101303 - DNA, 24 bp, Artificial Sequence
  Synthetic
ccgutagctgtaaucacaccacat

SEQ ID NO: 101304 - DNA, 21 bp, Artificial Sequence
  Synthetic
cagugtcaccaucgagcagag

SEQ ID NO: 101305 - DNA, 21 bp, Artificial Sequence
  Synthetic
acaggcgcutggttttacuga

SEQ ID NO: 101306 - DNA, 22 bp, Artificial Sequence
  Synthetic
ctgaagtcgucatcaaguggga

SEQ ID NO: 101307 - DNA, 22 bp, Artificial Sequence
  Synthetic
ctccacuggaatttggguccat

SEQ ID NO: 101308 - DNA, 19 bp, Artificial Sequence
  Synthetic
gggtcugcagggactcugt

SEQ ID NO: 101309 - DNA, 20 bp, Artificial Sequence
  Synthetic
caatctgcugttggcuaccc

SEQ ID NO: 101310 - DNA, 19 bp, Artificial Sequence
  Synthetic
gugggcccaagagccauaa

SEQ ID NO: 101311 - DNA, 19 bp, Artificial Sequence
  Synthetic
gcattgguggccttcucgt

SEQ ID NO: 101312 - DNA, 20 bp, Artificial Sequence
  Synthetic
cccaaaguccccgatctuga

SEQ ID NO: 101313 - DNA, 19 bp, Artificial Sequence
  Synthetic
ccggcuacguaagcaccag

SEQ ID NO: 101314 - DNA, 23 bp, Artificial Sequence
  Synthetic
catctaugaagggcucaccaact

SEQ ID NO: 101315 - DNA, 21 bp, Artificial Sequence
  Synthetic
cucaaagctcugcccaacaac

SEQ ID NO: 101316 - DNA, 17 bp, Artificial Sequence
  Synthetic
gcguagcggcucagagt

SEQ ID NO: 101317 - DNA, 19 bp, Artificial Sequence
  Synthetic
cagggtccuccagctcaut

SEQ ID NO: 101318 - DNA, 26 bp, Artificial Sequence
  Synthetic
tctgtaaatgaaaugcaaccctgcua

SEQ ID NO: 101319 - DNA, 25 bp, Artificial Sequence
  Synthetic
ggtttgcutcttatgcuggagaaca

SEQ ID NO: 101320 - DNA, 28 bp, Artificial Sequence
  Synthetic
gggacaatttcauttttccttctgucaa

SEQ ID NO: 101321 - DNA, 26 bp, Artificial Sequence
  Synthetic
tggtggcagutgaaagacattuaagt

SEQ ID NO: 101322 - DNA, 24 bp, Artificial Sequence
  Synthetic
gcctaaatgacaugtgctttggut

SEQ ID NO: 101323 - DNA, 19 bp, Artificial Sequence
  Synthetic
guactucaggacgcagggt

SEQ ID NO: 101324 - DNA, 20 bp, Artificial Sequence
  Synthetic
gctttguggaagccatgucc

SEQ ID NO: 101325 - DNA, 24 bp, Artificial Sequence
  Synthetic
gttgtttgctucggcttaatcuga

SEQ ID NO: 101326 - DNA, 24 bp, Artificial Sequence
  Synthetic
ggctttugaaaagggtctgaguct

SEQ ID NO: 101327 - DNA, 28 bp, Artificial Sequence
  Synthetic
cagggaagagguaattaacaaacugagg

SEQ ID NO: 101328 - DNA, 21 bp, Artificial Sequence
  Synthetic
tgttgcgatuctccctgctut

SEQ ID NO: 101329 - DNA, 27 bp, Artificial Sequence
  Synthetic
gttcaagccaauacaccaaagaaucac

SEQ ID NO: 101330 - DNA, 27 bp, Artificial Sequence
  Synthetic
aatactaagtttucagacttgccugct

SEQ ID NO: 101331 - DNA, 26 bp, Artificial Sequence
  Synthetic
tgaugagccatuagaaagaaccacaa

SEQ ID NO: 101332 - DNA, 21 bp, Artificial Sequence
  Synthetic
caccattggcaugggagcuat

SEQ ID NO: 101333 - DNA, 26 bp, Artificial Sequence
  Synthetic
aaaatttuaggagcaagcagtgtucc

SEQ ID NO: 101334 - DNA, 27 bp, Artificial Sequence
  Synthetic
cccttctgtagutatcaggtgaguagt

SEQ ID NO: 101335 - DNA, 25 bp, Artificial Sequence
  Synthetic
cagttggaugagagatggagagaut

SEQ ID NO: 101336 - DNA, 28 bp, Artificial Sequence
  Synthetic
accaaccttttgutaatgatctgtggua

SEQ ID NO: 101337 - DNA, 27 bp, Artificial Sequence
  Synthetic
agcaaactttugcaattgaaggaauca

SEQ ID NO: 101338 - DNA, 27 bp, Artificial Sequence
  Synthetic
tctctttaactgaautgctctgcauga

SEQ ID NO: 101339 - DNA, 23 bp, Artificial Sequence
  Synthetic
gcatcucgagacatacugaggga

SEQ ID NO: 101340 - DNA, 27 bp, Artificial Sequence
  Synthetic
cctcctgauttgtatgauaccaacaca

SEQ ID NO: 101341 - DNA, 26 bp, Artificial Sequence
  Synthetic
cacttgcaggcacaauaacaatctua

SEQ ID NO: 101342 - DNA, 25 bp, Artificial Sequence
  Synthetic
catcttuggaggctacugagaacaa

SEQ ID NO: 101343 - DNA, 27 bp, Artificial Sequence
  Synthetic
cctgttaggaugagatccgtaatguct

SEQ ID NO: 101344 - DNA, 24 bp, Artificial Sequence
  Synthetic
gcctcacucagaactgtctgttua

SEQ ID NO: 101345 - DNA, 23 bp, Artificial Sequence
  Synthetic
cugagaaugaagcccaaaagcag

SEQ ID NO: 101346 - DNA, 25 bp, Artificial Sequence
  Synthetic
tggataatttugccagctcatcucc

SEQ ID NO: 101347 - DNA, 28 bp, Artificial Sequence
  Synthetic
actgtgttcaucaaaagtgttctcucat

SEQ ID NO: 101348 - DNA, 20 bp, Artificial Sequence
  Synthetic
gtgcgguggaaatgccuaag

SEQ ID NO: 101349 - DNA, 22 bp, Artificial Sequence
  Synthetic
ggagauggcagaaaagctucgt

SEQ ID NO: 101350 - DNA, 25 bp, Artificial Sequence
  Synthetic
ggtaggacacutcaaccaaccatut

SEQ ID NO: 101351 - DNA, 28 bp, Artificial Sequence
  Synthetic
caacctgaaatugacactcctcaguaat

SEQ ID NO: 101352 - DNA, 28 bp, Artificial Sequence
  Synthetic
gtgagtttgatuagcttaaaacggctut

SEQ ID NO: 101353 - DNA, 21 bp, Artificial Sequence
  Synthetic
agcagggugatgaacctgtug

SEQ ID NO: 101354 - DNA, 19 bp, Artificial Sequence
  Synthetic
cagacctcugcgggatgug

SEQ ID NO: 101355 - DNA, 21 bp, Artificial Sequence
  Synthetic
ctacctugatggccuggaact

SEQ ID NO: 101356 - DNA, 21 bp, Artificial Sequence
  Synthetic
ccaaccccaacaggutcauca

SEQ ID NO: 101357 - DNA, 23 bp, Artificial Sequence
  Synthetic
ggaaccgugtctcgatuaaaccc

SEQ ID NO: 101358 - DNA, 20 bp, Artificial Sequence
  Synthetic
cgaatcacuccctgccatug

SEQ ID NO: 101359 - DNA, 26 bp, Artificial Sequence
  Synthetic
gtatacattggcugattgcgtaacug

SEQ ID NO: 101360 - DNA, 22 bp, Artificial Sequence
  Synthetic
aagttcagugggtaaccagucc

SEQ ID NO: 101361 - DNA, 25 bp, Artificial Sequence
  Synthetic
gccaautttctcugaaccagaccat

SEQ ID NO: 101362 - DNA, 20 bp, Artificial Sequence
  Synthetic
tggaaggcaucgtcgaucag

SEQ ID NO: 101363 - DNA, 24 bp, Artificial Sequence
  Synthetic
gcaacuaaagcucaagggaagaga

SEQ ID NO: 101364 - DNA, 23 bp, Artificial Sequence
  Synthetic
tgatggaaagugtgtgugcagaa

SEQ ID NO: 101365 - DNA, 18 bp, Artificial Sequence
  Synthetic
gtgtgaucggtggccuga

SEQ ID NO: 101366 - DNA, 19 bp, Artificial Sequence
  Synthetic
cagtucaggccaccgauca

SEQ ID NO: 101367 - DNA, 27 bp, Artificial Sequence
  Synthetic
gaaaacagtatgugttcagccaactut

SEQ ID NO: 101368 - DNA, 22 bp, Artificial Sequence
  Synthetic
aaagguaggcgcctctgtuaaa

SEQ ID NO: 101369 - DNA, 23 bp, Artificial Sequence
  Synthetic
caggtctgutaacgggatuccag

SEQ ID NO: 101370 - DNA, 23 bp, Artificial Sequence
  Synthetic
gtcctctaautgatcagguggca

SEQ ID NO: 101371 - DNA, 24 bp, Artificial Sequence
  Synthetic
gcttctuagccctctgugaaacat

SEQ ID NO: 101372 - DNA, 19 bp, Artificial Sequence
  Synthetic
catatcaggcugccgccua

SEQ ID NO: 101373 - DNA, 28 bp, Artificial Sequence
  Synthetic
tgtacacgtgguttgttaatgttttgut

SEQ ID NO: 101374 - DNA, 26 bp, Artificial Sequence
  Synthetic
aggatgtcuaggaacatgauggagaa

SEQ ID NO: 101375 - DNA, 23 bp, Artificial Sequence
  Synthetic
gguagccaaagacaaauccagca

SEQ ID NO: 101376 - DNA, 21 bp, Artificial Sequence
  Synthetic
caccgaaagggacgaugacua

SEQ ID NO: 101377 - DNA, 25 bp, Artificial Sequence
  Synthetic
tgtggtggaguttacaacttucaca

SEQ ID NO: 101378 - DNA, 23 bp, Artificial Sequence
  Synthetic
aaaagtctctugcttgagggcut

SEQ ID NO: 101379 - DNA, 20 bp, Artificial Sequence
  Synthetic
ggtggcacaccaaugcagua

SEQ ID NO: 101380 - DNA, 20 bp, Artificial Sequence
  Synthetic
cagggatacucgggccttuc

SEQ ID NO: 101381 - DNA, 22 bp, Artificial Sequence
  Synthetic
tgttccagggcuttgcttctua

SEQ ID NO: 101382 - DNA, 18 bp, Artificial Sequence
  Synthetic
gcagaugccgucgacaag

SEQ ID NO: 101383 - DNA, 22 bp, Artificial Sequence
  Synthetic
tgtttugtgcacgugaacaagg

SEQ ID NO: 101384 - DNA, 29 bp, Artificial Sequence
  Synthetic
actcccttuaaagaccttgctatagtuct

SEQ ID NO: 101385 - DNA, 28 bp, Artificial Sequence
  Synthetic
gccacagatgugatggaaatcgaaauat

SEQ ID NO: 101386 - DNA, 25 bp, Artificial Sequence
  Synthetic
gcaaactgauacacaagcaugcaaa

SEQ ID NO: 101387 - DNA, 29 bp, Artificial Sequence
  Synthetic
gcctgtcgacaauatctaatgaatctuga

SEQ ID NO: 101388 - DNA, 26 bp, Artificial Sequence
  Synthetic
atgaatgtcugcagcatctgtagaut

SEQ ID NO: 101389 - DNA, 25 bp, Artificial Sequence
  Synthetic
ttttccccuaatttgtcugagcaca

SEQ ID NO: 101390 - DNA, 23 bp, Artificial Sequence
  Synthetic
cacagaatgcutccatgtggtug

SEQ ID NO: 101391 - DNA, 22 bp, Artificial Sequence
  Synthetic
acccugcugaccaaagagaaag

SEQ ID NO: 101392 - DNA, 20 bp, Artificial Sequence
  Synthetic
gtccatcgucttgcctguct

SEQ ID NO: 101393 - DNA, 25 bp, Artificial Sequence
  Synthetic
catggagtugtcaaaaaccucgaaa

SEQ ID NO: 101394 - DNA, 22 bp, Artificial Sequence
  Synthetic
cagctguaactttggccuggat

SEQ ID NO: 101395 - DNA, 28 bp, Artificial Sequence
  Synthetic
ggagtttttgucagaaagtgaaaaugga

SEQ ID NO: 101396 - DNA, 21 bp, Artificial Sequence
  Synthetic
gccactcaucagggcaaagut

SEQ ID NO: 101397 - DNA, 22 bp, Artificial Sequence
  Synthetic
gatgtgagccgagucttccuac

SEQ ID NO: 101398 - DNA, 28 bp, Artificial Sequence
  Synthetic
caaccattacaaacutaaaaggccauca

SEQ ID NO: 101399 - DNA, 20 bp, Artificial Sequence
  Synthetic
agctuctgcagtucaagcgt

SEQ ID NO: 101400 - DNA, 22 bp, Artificial Sequence
  Synthetic
gtgaggaggccacuttacagut

SEQ ID NO: 101401 - DNA, 22 bp, Artificial Sequence
  Synthetic
ctggtauccgagtcttgugagg

SEQ ID NO: 101402 - DNA, 22 bp, Artificial Sequence
  Synthetic
cctggaaauacttctgcgugct

SEQ ID NO: 101403 - DNA, 23 bp, Artificial Sequence
  Synthetic
gatcacaccaucaccacatguca

SEQ ID NO: 101404 - DNA, 19 bp, Artificial Sequence
  Synthetic
agtgagcguggacugcaag

SEQ ID NO: 101405 - DNA, 28 bp, Artificial Sequence
  Synthetic
aatgaatacaugagtgtgatuccacagt

SEQ ID NO: 101406 - DNA, 20 bp, Artificial Sequence
  Synthetic
gtccccguggtcatcttgut

SEQ ID NO: 101407 - DNA, 20 bp, Artificial Sequence
  Synthetic
gcagcggaccucacactuac

SEQ ID NO: 101408 - DNA, 27 bp, Artificial Sequence
  Synthetic
atcttccuaaaggagaacggaaactug

SEQ ID NO: 101409 - DNA, 23 bp, Artificial Sequence
  Synthetic
tcatcagcaaaggucgcataugt

SEQ ID NO: 101410 - DNA, 20 bp, Artificial Sequence
  Synthetic
tgaggccccacuacagtuca

SEQ ID NO: 101411 - DNA, 23 bp, Artificial Sequence
  Synthetic
tgatgggcaacgucttcuagaac

SEQ ID NO: 101412 - DNA, 26 bp, Artificial Sequence
  Synthetic
accatagaagucgatcaaauccacac

SEQ ID NO: 101413 - DNA, 24 bp, Artificial Sequence
  Synthetic
aatgcatttggcutaccatcauct

SEQ ID NO: 101414 - DNA, 24 bp, Artificial Sequence
  Synthetic
cctacctgtcaucaacttgaccut

SEQ ID NO: 101415 - DNA, 28 bp, Artificial Sequence
  Synthetic
tggaaagttaucagagaaccgatcacua

SEQ ID NO: 101416 - DNA, 24 bp, Artificial Sequence
  Synthetic
ctaatagugtgtcccuggaaccaa

SEQ ID NO: 101417 - DNA, 23 bp, Artificial Sequence
  Synthetic
cacctguggctaatacagaugct

SEQ ID NO: 101418 - DNA, 28 bp, Artificial Sequence
  Synthetic
ggtgttttgtgaautaaaatgcccagua

SEQ ID NO: 101419 - DNA, 28 bp, Artificial Sequence
  Synthetic
ggatcttccaccuattagtagtctugga

SEQ ID NO: 101420 - DNA, 22 bp, Artificial Sequence
  Synthetic
tgggagguacctggtuaacaga

SEQ ID NO: 101421 - DNA, 21 bp, Artificial Sequence
  Synthetic
tgggcuacattttacguggca

SEQ ID NO: 101422 - DNA, 25 bp, Artificial Sequence
  Synthetic
gccatgatgauaacagcagcttuct

SEQ ID NO: 101423 - DNA, 22 bp, Artificial Sequence
  Synthetic
gtaccauctacccaauggccaa

SEQ ID NO: 101424 - DNA, 26 bp, Artificial Sequence
  Synthetic
tggtaccattuccatctcgaagaaua

SEQ ID NO: 101425 - DNA, 33 bp, Artificial Sequence
  Synthetic
ttagcacatttgaauactaggtttcttatuact

SEQ ID NO: 101426 - DNA, 26 bp, Artificial Sequence
  Synthetic
gtttctgcctuacacgatttggatut

SEQ ID NO: 101427 - DNA, 26 bp, Artificial Sequence
  Synthetic
cagcaguacagaaattctuggaacag

SEQ ID NO: 101428 - DNA, 20 bp, Artificial Sequence
  Synthetic
ggcttacccagutggccaut

SEQ ID NO: 101429 - DNA, 24 bp, Artificial Sequence
  Synthetic
gatctcgggaaaccuggagaaaut

SEQ ID NO: 101430 - DNA, 27 bp, Artificial Sequence
  Synthetic
tggaatataggauatgccagcugaaga

SEQ ID NO: 101431 - DNA, 23 bp, Artificial Sequence
  Synthetic
cttttgtgtcaugcaggttguca

SEQ ID NO: 101432 - DNA, 20 bp, Artificial Sequence
  Synthetic
gtggcuaggcctgtuacagt

SEQ ID NO: 101433 - DNA, 22 bp, Artificial Sequence
  Synthetic
cagactuaagcacccaccagut

SEQ ID NO: 101434 - DNA, 22 bp, Artificial Sequence
  Synthetic
gtctttuccagggatggacuca

SEQ ID NO: 101435 - DNA, 24 bp, Artificial Sequence
  Synthetic
tggtgtcuaagaggaaggtgtuca

SEQ ID NO: 101436 - DNA, 23 bp, Artificial Sequence
  Synthetic
ctactgcuggcactaagactuga

SEQ ID NO: 101437 - DNA, 23 bp, Artificial Sequence
  Synthetic
gttctacaggacuggaatgccut

SEQ ID NO: 101438 - DNA, 25 bp, Artificial Sequence
  Synthetic
acaaugggaggaagtaguacaacga

SEQ ID NO: 101439 - DNA, 23 bp, Artificial Sequence
  Synthetic
cgaacucgctgaaauccaagaga

SEQ ID NO: 101440 - DNA, 21 bp, Artificial Sequence
  Synthetic
gcatgctggcugatttccaut

SEQ ID NO: 101441 - DNA, 21 bp, Artificial Sequence
  Synthetic
aaggcagcuacatcctgacug

SEQ ID NO: 101442 - DNA, 28 bp, Artificial Sequence
  Synthetic
ctgcgacccaaacauaatcatagattuc

SEQ ID NO: 101443 - DNA, 28 bp, Artificial Sequence
  Synthetic
gacacttgugggaagcaatatgtttuat

SEQ ID NO: 101444 - DNA, 21 bp, Artificial Sequence
  Synthetic
tgcaaagcaccuggtgguaat

SEQ ID NO: 101445 - DNA, 24 bp, Artificial Sequence
  Synthetic
gtctctttgggutgtaactgctug

SEQ ID NO: 101446 - DNA, 21 bp, Artificial Sequence
  Synthetic
gagagaaggagutgctugcca

SEQ ID NO: 101447 - DNA, 26 bp, Artificial Sequence
  Synthetic
ccttaugggaaggaaacgaugaaaga

SEQ ID NO: 101448 - DNA, 23 bp, Artificial Sequence
  Synthetic
ccagaagcucagttcatucccaa

SEQ ID NO: 101449 - DNA, 28 bp, Artificial Sequence
  Synthetic
cccaccactaugacctctaatacuaaga

SEQ ID NO: 101450 - DNA, 28 bp, Artificial Sequence
  Synthetic
gctctaaatcaugatctggcatatcuga

SEQ ID NO: 101451 - DNA, 21 bp, Artificial Sequence
  Synthetic
acctcgaaucagggaagaucg

SEQ ID NO: 101452 - DNA, 26 bp, Artificial Sequence
  Synthetic
caagcutaactcttgaugacccagaa

SEQ ID NO: 101453 - DNA, 27 bp, Artificial Sequence
  Synthetic
gctttcttcatuttccatgtccaucct

SEQ ID NO: 101454 - DNA, 21 bp, Artificial Sequence
  Synthetic
tgaactggaugctacgcacuc

SEQ ID NO: 101455 - DNA, 22 bp, Artificial Sequence
  Synthetic
gggccggutgtttatgtcuaaa

SEQ ID NO: 101456 - DNA, 22 bp, Artificial Sequence
  Synthetic
gcctagcctugccaacatagut

SEQ ID NO: 101457 - DNA, 27 bp, Artificial Sequence
  Synthetic
gccgggatcagaugaaaaaggtttaua

SEQ ID NO: 101458 - DNA, 20 bp, Artificial Sequence
  Synthetic
cccctaactuccggctccua

SEQ ID NO: 101459 - DNA, 21 bp, Artificial Sequence
  Synthetic
gagagaugugcagcagcagat

SEQ ID NO: 101460 - DNA, 21 bp, Artificial Sequence
  Synthetic
cgcaugctucaggagaacaca

SEQ ID NO: 101461 - DNA, 24 bp, Artificial Sequence
  Synthetic
ctgtagcatgutgctgtcgatuac

SEQ ID NO: 101462 - DNA, 26 bp, Artificial Sequence
  Synthetic
caggaaaugaagatttgcucagcaat

SEQ ID NO: 101463 - DNA, 21 bp, Artificial Sequence
  Synthetic
cagccttcaguatggccctua

SEQ ID NO: 101464 - DNA, 17 bp, Artificial Sequence
  Synthetic
ctcguggcctcggucag

SEQ ID NO: 101465 - DNA, 28 bp, Artificial Sequence
  Synthetic
tgttgatgtcccuacttagctgttuaga

SEQ ID NO: 101466 - DNA, 26 bp, Artificial Sequence
  Synthetic
tttctttacgtuctgctcttttugcc

SEQ ID NO: 101467 - DNA, 22 bp, Artificial Sequence
  Synthetic
acatccaauccgcccaacauac

SEQ ID NO: 101468 - DNA, 33 bp, Artificial Sequence
  Synthetic
gcacttacctcacutagtaatatatttaaugct

SEQ ID NO: 101469 - DNA, 28 bp, Artificial Sequence
  Synthetic
gtggaaaagttuctggcttgatuaaaga

SEQ ID NO: 101470 - DNA, 28 bp, Artificial Sequence
  Synthetic
accaataaggtucatgctcaccaatuat

SEQ ID NO: 101471 - DNA, 25 bp, Artificial Sequence
  Synthetic
tgaacaggagauactggatgcttug

SEQ ID NO: 101472 - DNA, 24 bp, Artificial Sequence
  Synthetic
ctctgttcuaggctctgcttttug

SEQ ID NO: 101473 - DNA, 27 bp, Artificial Sequence
  Synthetic
ttcattgaatcuaccatgttggttcut

SEQ ID NO: 101474 - DNA, 21 bp, Artificial Sequence
  Synthetic
actgcaguctacgtugcaaca

SEQ ID NO: 101475 - DNA, 28 bp, Artificial Sequence
  Synthetic
gctatcttcuaaccattcctcctttuct

SEQ ID NO: 101476 - DNA, 25 bp, Artificial Sequence
  Synthetic
cctttcatgaccugctctttttgut

SEQ ID NO: 101477 - DNA, 23 bp, Artificial Sequence
  Synthetic
tttggguagacatgaagcuggag

SEQ ID NO: 101478 - DNA, 27 bp, Artificial Sequence
  Synthetic
ttatguagaaccgctacttugagaacc

SEQ ID NO: 101479 - DNA, 28 bp, Artificial Sequence
  Synthetic
ggtagaaataacucagcgaaacactuac

SEQ ID NO: 101480 - DNA, 21 bp, Artificial Sequence
  Synthetic
cctggtggucactggaugaag

SEQ ID NO: 101481 - DNA, 29 bp, Artificial Sequence
  Synthetic
tgtgtagatatgguagtgagctctgatut

SEQ ID NO: 101482 - DNA, 28 bp, Artificial Sequence
  Synthetic
ccaaagctgaaaacugtaagtctaguga

SEQ ID NO: 101483 - DNA, 29 bp, Artificial Sequence
  Synthetic
caaccctgatgacuctcctttatatgtut

SEQ ID NO: 101484 - DNA, 28 bp, Artificial Sequence
  Synthetic
gtccatgtaaaacugcaagtgtcatuac

SEQ ID NO: 101485 - DNA, 26 bp, Artificial Sequence
  Synthetic
gtcctttccugaaagatgaactgcua

SEQ ID NO: 101486 - DNA, 19 bp, Artificial Sequence
  Synthetic
tgagtggugcctcctccut

SEQ ID NO: 101487 - DNA, 20 bp, Artificial Sequence
  Synthetic
tgctccaccacgutaagguc

SEQ ID NO: 101488 - DNA, 20 bp, Artificial Sequence
  Synthetic
caatguggcggcttguaaca

SEQ ID NO: 101489 - DNA, 24 bp, Artificial Sequence
  Synthetic
tcatgttgtguttctagacguggt

SEQ ID NO: 101490 - DNA, 20 bp, Artificial Sequence
  Synthetic
cagcccaggcuctucacaat

SEQ ID NO: 101491 - DNA, 20 bp, Artificial Sequence
  Synthetic
ctgaccagucttcgcguaca

SEQ ID NO: 101492 - DNA, 20 bp, Artificial Sequence
  Synthetic
ctgctggucctcauccagat

SEQ ID NO: 101493 - DNA, 23 bp, Artificial Sequence
  Synthetic
gcccaacgcaaacauctctgaua

SEQ ID NO: 101494 - DNA, 23 bp, Artificial Sequence
  Synthetic
catgtacaccaccugagtgctua

SEQ ID NO: 101495 - DNA, 25 bp, Artificial Sequence
  Synthetic
catgcagggcagugaagaattatut

SEQ ID NO: 101496 - DNA, 21 bp, Artificial Sequence
  Synthetic
tggtggtaguggttccacuga

SEQ ID NO: 101497 - DNA, 23 bp, Artificial Sequence
  Synthetic
caacgtagcagagucactgatug

SEQ ID NO: 101498 - DNA, 24 bp, Artificial Sequence
  Synthetic
gactgtctcuctctccttgtcuca

SEQ ID NO: 101499 - DNA, 20 bp, Artificial Sequence
  Synthetic
gagccccaucagttccucac

SEQ ID NO: 101500 - DNA, 22 bp, Artificial Sequence
  Synthetic
gcaauccccattcugacaggaa

SEQ ID NO: 101501 - DNA, 25 bp, Artificial Sequence
  Synthetic
tcuagcaactttatuccacagccaa

SEQ ID NO: 101502 - DNA, 24 bp, Artificial Sequence
  Synthetic
ggaatacacgcutgcatttuccaa

SEQ ID NO: 101503 - DNA, 28 bp, Artificial Sequence
  Synthetic
catccaaaaagaaaaaguaaggcaucct

SEQ ID NO: 101504 - DNA, 25 bp, Artificial Sequence
  Synthetic
gctgtttucccatctgacttugagt

SEQ ID NO: 101505 - DNA, 21 bp, Artificial Sequence
  Synthetic
tcctggatcugctcttccugt

SEQ ID NO: 101506 - DNA, 20 bp, Artificial Sequence
  Synthetic
aagaagcaccgugagcugat

SEQ ID NO: 101507 - DNA, 28 bp, Artificial Sequence
  Synthetic
ccttaatctcagguctctattttgccua

SEQ ID NO: 101508 - DNA, 26 bp, Artificial Sequence
  Synthetic
gggattgcacutaatgtgtaucaact

SEQ ID NO: 101509 - DNA, 24 bp, Artificial Sequence
  Synthetic
tgagacaacautgcgtgatctuca

SEQ ID NO: 101510 - DNA, 27 bp, Artificial Sequence
  Synthetic
tgctgggacaagutgtccttaauaaat

SEQ ID NO: 101511 - DNA, 25 bp, Artificial Sequence
  Synthetic
gccaaatgcuagaaaggaggatcut

SEQ ID NO: 101512 - DNA, 27 bp, Artificial Sequence
  Synthetic
ttgttttaggauaaaggaggcctuacc

SEQ ID NO: 101513 - DNA, 28 bp, Artificial Sequence
  Synthetic
gtatcagagagaccuaaaggcattugaa

SEQ ID NO: 101514 - DNA, 27 bp, Artificial Sequence
  Synthetic
atgaagaauaaagaccctgactuggac

SEQ ID NO: 101515 - DNA, 21 bp, Artificial Sequence
  Synthetic
gccacatcugttgcaggugaa

SEQ ID NO: 101516 - DNA, 22 bp, Artificial Sequence
  Synthetic
cutgttctugccccaaccaaac

SEQ ID NO: 101517 - DNA, 28 bp, Artificial Sequence
  Synthetic
agtgaattacagcacacugatgcttuat

SEQ ID NO: 101518 - DNA, 28 bp, Artificial Sequence
  Synthetic
tttctgtgatgcuttaagttgagggtua

SEQ ID NO: 101519 - DNA, 25 bp, Artificial Sequence
  Synthetic
gagtttgcaggautggttttucagt

SEQ ID NO: 101520 - DNA, 27 bp, Artificial Sequence
  Synthetic
gggaagggatuaatttttcacatgugt

SEQ ID NO: 101521 - DNA, 22 bp, Artificial Sequence
  Synthetic
gcttgagguacaggtuggagag

SEQ ID NO: 101522 - DNA, 23 bp, Artificial Sequence
  Synthetic
ccaattccaauctgtctggcugt

SEQ ID NO: 101523 - DNA, 28 bp, Artificial Sequence
  Synthetic
gggcacagaauctctttgttgaauaaat

SEQ ID NO: 101524 - DNA, 20 bp, Artificial Sequence
  Synthetic
cagaaatgggcuccaacgug

SEQ ID NO: 101525 - DNA, 25 bp, Artificial Sequence
  Synthetic
aaaaacccugaacagaagcacuact

SEQ ID NO: 101526 - DNA, 20 bp, Artificial Sequence
  Synthetic
ggtagccccucagctugaac

SEQ ID NO: 101527 - DNA, 21 bp, Artificial Sequence
  Synthetic
gactguccccaggacatcuac

SEQ ID NO: 101528 - DNA, 27 bp, Artificial Sequence
  Synthetic
aatgactcauaggacttactgccuaga

SEQ ID NO: 101529 - DNA, 24 bp, Artificial Sequence
  Synthetic
cttcagtgcauaaaattcggcugt

SEQ ID NO: 101530 - DNA, 19 bp, Artificial Sequence
  Synthetic
agcacuggaccatgacgut

SEQ ID NO: 101531 - DNA, 18 bp, Artificial Sequence
  Synthetic
gggcgcuctgtttgucgt

SEQ ID NO: 101532 - DNA, 22 bp, Artificial Sequence
  Synthetic
actcctccaagutggtgacuga

SEQ ID NO: 101533 - DNA, 28 bp, Artificial Sequence
  Synthetic
agcatctgaattuagatgacaaggagut

SEQ ID NO: 101534 - DNA, 25 bp, Artificial Sequence
  Synthetic
tcacaaaagagaugacagccgaaut

SEQ ID NO: 101535 - DNA, 29 bp, Artificial Sequence
  Synthetic
agcttcacattggcutcaggttataaaua

SEQ ID NO: 101536 - DNA, 26 bp, Artificial Sequence
  Synthetic
ttgctctaaatgacucgtctgttcut

SEQ ID NO: 101537 - DNA, 23 bp, Artificial Sequence
  Synthetic
ctgatgcagagaguacagctguc

SEQ ID NO: 101538 - DNA, 26 bp, Artificial Sequence
  Synthetic
tgaagaatttcauaccgtctgcctuc

SEQ ID NO: 101539 - DNA, 26 bp, Artificial Sequence
  Synthetic
agctcaatuacgttatggttcugcat

SEQ ID NO: 101540 - DNA, 20 bp, Artificial Sequence
  Synthetic
gggcccagguatctggcuat

SEQ ID NO: 101541 - DNA, 19 bp, Artificial Sequence
  Synthetic
gctgctuctctcccugacc

SEQ ID NO: 101542 - DNA, 19 bp, Artificial Sequence
  Synthetic
caggcgcugguaagcagat

SEQ ID NO: 101543 - DNA, 18 bp, Artificial Sequence
  Synthetic
ggcccugcacttcuggag

SEQ ID NO: 101544 - DNA, 21 bp, Artificial Sequence
  Synthetic
caggaucaccagcagatgcua

SEQ ID NO: 101545 - DNA, 29 bp, Artificial Sequence
  Synthetic
ctgctgtatcgaauttagctctattugga

SEQ ID NO: 101546 - DNA, 22 bp, Artificial Sequence
  Synthetic
gccatcucagcctgttgtctut

SEQ ID NO: 101547 - DNA, 24 bp, Artificial Sequence
  Synthetic
tgtctgucagagaggatctuccac

SEQ ID NO: 101548 - DNA, 21 bp, Artificial Sequence
  Synthetic
ggtccagcutttccccagaut

SEQ ID NO: 101549 - DNA, 28 bp, Artificial Sequence
  Synthetic
acttgttcgagacugtgttcttttauga

SEQ ID NO: 101550 - DNA, 20 bp, Artificial Sequence
  Synthetic
acctccugcccaaagctcua

SEQ ID NO: 101551 - DNA, 20 bp, Artificial Sequence
  Synthetic
ctgagtucacccaggcugac

SEQ ID NO: 101552 - DNA, 20 bp, Artificial Sequence
  Synthetic
gcccautcatcugcgacaag

SEQ ID NO: 101553 - DNA, 25 bp, Artificial Sequence
  Synthetic
ttttgttcttutcaggagcuccaga

SEQ ID NO: 101554 - DNA, 23 bp, Artificial Sequence
  Synthetic
tgatggagaggaugatggcttug

SEQ ID NO: 101555 - DNA, 26 bp, Artificial Sequence
  Synthetic
ccatcctgtuaaggccagtttaaaut

SEQ ID NO: 101556 - DNA, 23 bp, Artificial Sequence
  Synthetic
acaatgtgacutgacacggcuat

SEQ ID NO: 101557 - DNA, 29 bp, Artificial Sequence
  Synthetic
ctgaagattgatguggagaagaataggut

SEQ ID NO: 101558 - DNA, 26 bp, Artificial Sequence
  Synthetic
ttctgcattctuctacagaggcuaag

SEQ ID NO: 101559 - DNA, 28 bp, Artificial Sequence
  Synthetic
tgccacttcaautgggaatgtacauaat

SEQ ID NO: 101560 - DNA, 22 bp, Artificial Sequence
  Synthetic
agctgagucactgtcatugcat

SEQ ID NO: 101561 - DNA, 28 bp, Artificial Sequence
  Synthetic
cctatgtagcccaguttctgaaacatua

SEQ ID NO: 101562 - DNA, 20 bp, Artificial Sequence
  Synthetic
ccccgcuctgcattcuacaa

SEQ ID NO: 101563 - DNA, 28 bp, Artificial Sequence
  Synthetic
ctgattccctaugtgccctaaaaauaga

SEQ ID NO: 101564 - DNA, 22 bp, Artificial Sequence
  Synthetic
gcttgcautgtggatgucagga

SEQ ID NO: 101565 - DNA, 27 bp, Artificial Sequence
  Synthetic
ggtgtgatagcuagataccaaactugt

SEQ ID NO: 101566 - DNA, 22 bp, Artificial Sequence
  Synthetic
ttugactggattauggccccaa

SEQ ID NO: 101567 - DNA, 25 bp, Artificial Sequence
  Synthetic
ccctggagaaacuacgaacttucaa

SEQ ID NO: 101568 - DNA, 23 bp, Artificial Sequence
  Synthetic
ttctggucaacaataugccacca

SEQ ID NO: 101569 - DNA, 22 bp, Artificial Sequence
  Synthetic
cgutccacagauggcagaaaac

SEQ ID NO: 101570 - DNA, 23 bp, Artificial Sequence
  Synthetic
ggagagacugcgaaagcttctut

SEQ ID NO: 101571 - DNA, 28 bp, Artificial Sequence
  Synthetic
ccccagtttccuacatcaaaaacatcua

SEQ ID NO: 101572 - DNA, 22 bp, Artificial Sequence
  Synthetic
ggtggttauccaggttgcugat

SEQ ID NO: 101573 - DNA, 23 bp, Artificial Sequence
  Synthetic
ccatggcttcugtttctctccua

SEQ ID NO: 101574 - DNA, 28 bp, Artificial Sequence
  Synthetic
ctgtagcttugacaaagatcaggaauct

SEQ ID NO: 101575 - DNA, 26 bp, Artificial Sequence
  Synthetic
caaautgaggctaauggagcaaaagt

SEQ ID NO: 101576 - DNA, 22 bp, Artificial Sequence
  Synthetic
gcctcugaccttaggauggaga

SEQ ID NO: 101577 - DNA, 18 bp, Artificial Sequence
  Synthetic
cucgcucgaccaccgaaa

SEQ ID NO: 101578 - DNA, 18 bp, Artificial Sequence
  Synthetic
ccccguagaggcggauga

SEQ ID NO: 101579 - DNA, 22 bp, Artificial Sequence
  Synthetic
agtcctgaguccttgcaaaucc

SEQ ID NO: 101580 - DNA, 26 bp, Artificial Sequence
  Synthetic
tgttttgagccautcatctactugct

SEQ ID NO: 101581 - DNA, 22 bp, Artificial Sequence
  Synthetic
tgatcccaucaggtaucccaca

SEQ ID NO: 101582 - DNA, 25 bp, Artificial Sequence
  Synthetic
cgtgttgtgguttgttcatttucct

SEQ ID NO: 101583 - DNA, 22 bp, Artificial Sequence
  Synthetic
gttcuggagaacccaagugaga

SEQ ID NO: 101584 - DNA, 20 bp, Artificial Sequence
  Synthetic
ctctaaagcccggucctcug

SEQ ID NO: 101585 - DNA, 22 bp, Artificial Sequence
  Synthetic
acatgcuaacccatgcaagugt

SEQ ID NO: 101586 - DNA, 28 bp, Artificial Sequence
  Synthetic
gtgtggtgtcuattaagtttctcaugga

SEQ ID NO: 101587 - DNA, 27 bp, Artificial Sequence
  Synthetic
tucaggaaaccaccattucaaaaacag

SEQ ID NO: 101588 - DNA, 28 bp, Artificial Sequence
  Synthetic
acgctguactgaacaauaaaaacaaagg

SEQ ID NO: 101589 - DNA, 21 bp, Artificial Sequence
  Synthetic
cgtgcugccagaagaaacuga

SEQ ID NO: 101590 - DNA, 18 bp, Artificial Sequence
  Synthetic
cgaggtgutgggctucct

SEQ ID NO: 101591 - DNA, 19 bp, Artificial Sequence
  Synthetic
tgccacaaagugcuggaga

SEQ ID NO: 101592 - DNA, 20 bp, Artificial Sequence
  Synthetic
ctccaggutccagucgaaca

SEQ ID NO: 101593 - DNA, 20 bp, Artificial Sequence
  Synthetic
ccctctuccccaccctaguc

SEQ ID NO: 101594 - DNA, 22 bp, Artificial Sequence
  Synthetic
agatggcccuggttttgaacuc

SEQ ID NO: 101595 - DNA, 28 bp, Artificial Sequence
  Synthetic
ggttctuccaacaaaaatgtcttaugct

SEQ ID NO: 101596 - DNA, 28 bp, Artificial Sequence
  Synthetic
gttcattacauttttcagatuggcagca

SEQ ID NO: 101597 - DNA, 24 bp, Artificial Sequence
  Synthetic
ccautgaagcuccagaaagggaaa

SEQ ID NO: 101598 - DNA, 20 bp, Artificial Sequence
  Synthetic
ccaccaguggaatgcaccua

SEQ ID NO: 101599 - DNA, 25 bp, Artificial Sequence
  Synthetic
cctucccagaaacaaacaagucact

SEQ ID NO: 101600 - DNA, 21 bp, Artificial Sequence
  Synthetic
actccaacuaccagctggcua

SEQ ID NO: 101601 - DNA, 25 bp, Artificial Sequence
  Synthetic
acgttttgaagautggctgaaguct

SEQ ID NO: 101602 - DNA, 23 bp, Artificial Sequence
  Synthetic
ggaaaagcagcugtcctttcuga

SEQ ID NO: 101603 - DNA, 28 bp, Artificial Sequence
  Synthetic
agcgaaaacaguctccaataatcugaat

SEQ ID NO: 101604 - DNA, 28 bp, Artificial Sequence
  Synthetic
ttaccacacautaagacacaaauagcct

SEQ ID NO: 101605 - DNA, 27 bp, Artificial Sequence
  Synthetic
cagtcacuccacagaatgtataugagt

SEQ ID NO: 101606 - DNA, 25 bp, Artificial Sequence
  Synthetic
accaacattctgugttctgcgtaut

SEQ ID NO: 101607 - DNA, 28 bp, Artificial Sequence
  Synthetic
tgacaaaattgccuttaaatagcacugg

SEQ ID NO: 101608 - DNA, 22 bp, Artificial Sequence
  Synthetic
gccaggaggacagauatuccat

SEQ ID NO: 101609 - DNA, 20 bp, Artificial Sequence
  Synthetic
cagagcuggccaagccaaua

SEQ ID NO: 101610 - DNA, 25 bp, Artificial Sequence
  Synthetic
tgacttucctttaagcuggcaaact

SEQ ID NO: 101611 - DNA, 19 bp, Artificial Sequence
  Synthetic
cctggagugggaucacgac

SEQ ID NO: 101612 - DNA, 25 bp, Artificial Sequence
  Synthetic
tcttccgagtuacaggaatcguaga

SEQ ID NO: 101613 - DNA, 20 bp, Artificial Sequence
  Synthetic
ctctcgcugaagugggacat

SEQ ID NO: 101614 - DNA, 21 bp, Artificial Sequence
  Synthetic
caggtcccgacugaggtcaua

SEQ ID NO: 101615 - DNA, 20 bp, Artificial Sequence
  Synthetic
tgcagacagccugctttcuc

SEQ ID NO: 101616 - DNA, 23 bp, Artificial Sequence
  Synthetic
cgtgacacauacacgttacugga

SEQ ID NO: 101617 - DNA, 26 bp, Artificial Sequence
  Synthetic
gtatttcttcaaugccgaacaucact

SEQ ID NO: 101618 - DNA, 21 bp, Artificial Sequence
  Synthetic
gagagatuggaggaaggcugt

SEQ ID NO: 101619 - DNA, 20 bp, Artificial Sequence
  Synthetic
tgacagggutgccttgacut

SEQ ID NO: 101620 - DNA, 23 bp, Artificial Sequence
  Synthetic
ggtttcttgucctcactcugcat

SEQ ID NO: 101621 - DNA, 26 bp, Artificial Sequence
  Synthetic
gagaaaggcagucaaagtgtucaaaa

SEQ ID NO: 101622 - DNA, 23 bp, Artificial Sequence
  Synthetic
ccatcactuacctggguaccaac

SEQ ID NO: 101623 - DNA, 28 bp, Artificial Sequence
  Synthetic
ggctgttttacugcttatttgaccaaut

SEQ ID NO: 101624 - DNA, 23 bp, Artificial Sequence
  Synthetic
ggttugagagcatgcttuccaat

SEQ ID NO: 101625 - DNA, 21 bp, Artificial Sequence
  Synthetic
ccctacaagauctggcugacc

SEQ ID NO: 101626 - DNA, 22 bp, Artificial Sequence
  Synthetic
cacgtugctcaaggucacaaac

SEQ ID NO: 101627 - DNA, 29 bp, Artificial Sequence
  Synthetic
tctttctttctctcucactctgtcttgua

SEQ ID NO: 101628 - DNA, 24 bp, Artificial Sequence
  Synthetic
tcttctccugaccagtttcuagca

SEQ ID NO: 101629 - DNA, 25 bp, Artificial Sequence
  Synthetic
gagtcttgtgguctctgcttctuag

SEQ ID NO: 101630 - DNA, 28 bp, Artificial Sequence
  Synthetic
ccagttaagagguaactaaguacacagt

SEQ ID NO: 101631 - DNA, 24 bp, Artificial Sequence
  Synthetic
gaagacagcttuccatcgacacua

SEQ ID NO: 101632 - DNA, 22 bp, Artificial Sequence
  Synthetic
tccctucagaggctggtcuaaa

SEQ ID NO: 101633 - DNA, 28 bp, Artificial Sequence
  Synthetic
actgaacaacctauatgctctggtttuc

SEQ ID NO: 101634 - DNA, 23 bp, Artificial Sequence
  Synthetic
aagaagcccaugattcaucagca

SEQ ID NO: 101635 - DNA, 19 bp, Artificial Sequence
  Synthetic
gatccccgaggaugtggut

SEQ ID NO: 101636 - DNA, 22 bp, Artificial Sequence
  Synthetic
agagcagcaugacagagaggua

SEQ ID NO: 101637 - DNA, 28 bp, Artificial Sequence
  Synthetic
gaaattgcatttucagcatttgttguct

SEQ ID NO: 101638 - DNA, 25 bp, Artificial Sequence
  Synthetic
gaucacaucaacacaaaacaggcaa

SEQ ID NO: 101639 - DNA, 22 bp, Artificial Sequence
  Synthetic
caccugaagtugacagggagat

SEQ ID NO: 101640 - DNA, 23 bp, Artificial Sequence
  Synthetic
gctgtcggautacagtgacacut

SEQ ID NO: 101641 - DNA, 23 bp, Artificial Sequence
  Synthetic
cccguagcagcaagaagtagtug

SEQ ID NO: 101642 - DNA, 21 bp, Artificial Sequence
  Synthetic
caggtgaccuctaagcggtut

SEQ ID NO: 101643 - DNA, 27 bp, Artificial Sequence
  Synthetic
agaagatgaautgaattcucacgagca

SEQ ID NO: 101644 - DNA, 24 bp, Artificial Sequence
  Synthetic
ccaacatagutcatgctcgugaga

SEQ ID NO: 101645 - DNA, 27 bp, Artificial Sequence
  Synthetic
gctgtctaaaugagtgctttauggact

SEQ ID NO: 101646 - DNA, 20 bp, Artificial Sequence
  Synthetic
cagacugccaaggaacccua

SEQ ID NO: 101647 - DNA, 26 bp, Artificial Sequence
  Synthetic
acaagacuaaaaggcaaccaaaguca

SEQ ID NO: 101648 - DNA, 23 bp, Artificial Sequence
  Synthetic
ccaaauaccttaucaggccacca

SEQ ID NO: 101649 - DNA, 26 bp, Artificial Sequence
  Synthetic
ggcttgauggagcctcatttgauaat

SEQ ID NO: 101650 - DNA, 22 bp, Artificial Sequence
  Synthetic
ccttgctgguagaaccccttuc

SEQ ID NO: 101651 - DNA, 21 bp, Artificial Sequence
  Synthetic
ggtgugacccaattgcauacc

SEQ ID NO: 101652 - DNA, 21 bp, Artificial Sequence
  Synthetic
cgccagagcaggutgtaacua

SEQ ID NO: 101653 - DNA, 20 bp, Artificial Sequence
  Synthetic
ccgutcaacagguccacgag

SEQ ID NO: 101654 - DNA, 28 bp, Artificial Sequence
  Synthetic
gcattaaaaggauaaagaagtgtuggca

SEQ ID NO: 101655 - DNA, 28 bp, Artificial Sequence
  Synthetic
ctgcctttctcucattctaactgtctua

SEQ ID NO: 101656 - DNA, 24 bp, Artificial Sequence
  Synthetic
ccgttgtatcgugtttgctgttuc

SEQ ID NO: 101657 - DNA, 25 bp, Artificial Sequence
  Synthetic
gctctttgacuggcatatacagcut

SEQ ID NO: 101658 - DNA, 29 bp, Artificial Sequence
  Synthetic
tgaagaactttguatgtttctgtagcuga

SEQ ID NO: 101659 - DNA, 28 bp, Artificial Sequence
  Synthetic
gtcttgctatgtauctttcccactgtua

SEQ ID NO: 101660 - DNA, 21 bp, Artificial Sequence
  Synthetic
ctctcucaagccagtggtugt

SEQ ID NO: 101661 - DNA, 28 bp, Artificial Sequence
  Synthetic
caagctgagaagaucttggatacugaaa

SEQ ID NO: 101662 - DNA, 25 bp, Artificial Sequence
  Synthetic
agtaacugctgtgctucaaacagat

SEQ ID NO: 101663 - DNA, 28 bp, Artificial Sequence
  Synthetic
aggttgaaaagaugctaagcaatttugg

SEQ ID NO: 101664 - DNA, 22 bp, Artificial Sequence
  Synthetic
aaccagucacaacagtgcctua

SEQ ID NO: 101665 - DNA, 23 bp, Artificial Sequence
  Synthetic
ccctccaguccatctcuacgaag

SEQ ID NO: 101666 - DNA, 21 bp, Artificial Sequence
  Synthetic
tttcagcucaatggccuccat

SEQ ID NO: 101667 - DNA, 28 bp, Artificial Sequence
  Synthetic
gcatttggtaataucccttttctggugt

SEQ ID NO: 101668 - DNA, 32 bp, Artificial Sequence
  Synthetic
agtaaaagctaagcuaagctaaatctucacat

SEQ ID NO: 101669 - DNA, 28 bp, Artificial Sequence
  Synthetic
cgaaaggcgaaugctcattttatatuga

SEQ ID NO: 101670 - DNA, 27 bp, Artificial Sequence
  Synthetic
ggagaaccacacugtcacataacaaut

SEQ ID NO: 101671 - DNA, 28 bp, Artificial Sequence
  Synthetic
gtgtcttctucattgttgttttguacca

SEQ ID NO: 101672 - DNA, 28 bp, Artificial Sequence
  Synthetic
ctcagagaagaaaguttaggacttguca

SEQ ID NO: 101673 - DNA, 22 bp, Artificial Sequence
  Synthetic
gtccaggcugagaaccttguaa

SEQ ID NO: 101674 - DNA, 22 bp, Artificial Sequence
  Synthetic
agcggtatcuctgaagctucct

SEQ ID NO: 101675 - DNA, 26 bp, Artificial Sequence
  Synthetic
tgcactttattugagggcagagauaa

SEQ ID NO: 101676 - DNA, 28 bp, Artificial Sequence
  Synthetic
tcaaaagtacucaagaaggaaugaagca

SEQ ID NO: 101677 - DNA, 21 bp, Artificial Sequence
  Synthetic
gaactucaccggtggucagat

SEQ ID NO: 101678 - DNA, 23 bp, Artificial Sequence
  Synthetic
gtggcugatgaatcuccagacat

SEQ ID NO: 101679 - DNA, 28 bp, Artificial Sequence
  Synthetic
accactgttaagguagtcttttcttugt

SEQ ID NO: 101680 - DNA, 27 bp, Artificial Sequence
  Synthetic
gcaaacgcatauagtagtctcaagcua

SEQ ID NO: 101681 - DNA, 28 bp, Artificial Sequence
  Synthetic
aagaacaggaugatattgttucagcaga

SEQ ID NO: 101682 - DNA, 22 bp, Artificial Sequence
  Synthetic
ctgtaagcaacacccuggtcut

SEQ ID NO: 101683 - DNA, 21 bp, Artificial Sequence
  Synthetic
tcacagtucttgagcgugagg

SEQ ID NO: 101684 - DNA, 27 bp, Artificial Sequence
  Synthetic
accacaatuaaaatcacctctuccaca

SEQ ID NO: 101685 - DNA, 28 bp, Artificial Sequence
  Synthetic
cccactcauaagcttctgattcttuaca

SEQ ID NO: 101686 - DNA, 26 bp, Artificial Sequence
  Synthetic
ttgtttaaaaagggcacucgattgug

SEQ ID NO: 101687 - DNA, 21 bp, Artificial Sequence
  Synthetic
cagcagctgutgattccgtug

SEQ ID NO: 101688 - DNA, 26 bp, Artificial Sequence
  Synthetic
agggtacacguaatcccatttttguc

SEQ ID NO: 101689 - DNA, 25 bp, Artificial Sequence
  Synthetic
ggatagtauggaagccaaccugaat

SEQ ID NO: 101690 - DNA, 26 bp, Artificial Sequence
  Synthetic
gacgtcatcugcttttctaattccuc

SEQ ID NO: 101691 - DNA, 28 bp, Artificial Sequence
  Synthetic
ggcacttaatgguctttcatggaattut

SEQ ID NO: 101692 - DNA, 26 bp, Artificial Sequence
  Synthetic
ccaaaccctauaaacaggcctuaaga

SEQ ID NO: 101693 - DNA, 21 bp, Artificial Sequence
  Synthetic
gcggugaagtcaatgugcaaa

SEQ ID NO: 101694 - DNA, 28 bp, Artificial Sequence
  Synthetic
tcattgaaagagguaaaactgaucagca

SEQ ID NO: 101695 - DNA, 28 bp, Artificial Sequence
  Synthetic
aaaggtctacuagatgtgctuccaaaaa

SEQ ID NO: 101696 - DNA, 29 bp, Artificial Sequence
  Synthetic
gcctaaaatcttcugccgttaaatctuct

SEQ ID NO: 101697 - DNA, 26 bp, Artificial Sequence
  Synthetic
ggctgctaaaautatgtcttgtgcut

SEQ ID NO: 101698 - DNA, 26 bp, Artificial Sequence
  Synthetic
aaaacataagtaugcccacacctuct

SEQ ID NO: 101699 - DNA, 25 bp, Artificial Sequence
  Synthetic
ccacttttuacagccttgugaacaa

SEQ ID NO: 101700 - DNA, 21 bp, Artificial Sequence
  Synthetic
cgcatgcugcctttctgatuc

SEQ ID NO: 101701 - DNA, 28 bp, Artificial Sequence
  Synthetic
gactcctaaggautctcaatgtggatut

SEQ ID NO: 101702 - DNA, 22 bp, Artificial Sequence
  Synthetic
cacagcatggautcgcttcauc

SEQ ID NO: 101703 - DNA, 24 bp, Artificial Sequence
  Synthetic
gaaagtgaacaaugttggttgcut

SEQ ID NO: 101704 - DNA, 24 bp, Artificial Sequence
  Synthetic
aggagacacuccattcugacaagt

SEQ ID NO: 101705 - DNA, 28 bp, Artificial Sequence
  Synthetic
cgtcatatcaaggaacuggagaagtuat

SEQ ID NO: 101706 - DNA, 24 bp, Artificial Sequence
  Synthetic
ggcttgtccuttgaaatcccugaa

SEQ ID NO: 101707 - DNA, 22 bp, Artificial Sequence
  Synthetic
agaacgagccugttctgtugac

SEQ ID NO: 101708 - DNA, 23 bp, Artificial Sequence
  Synthetic
ctgctgactacutgacacgtcua

SEQ ID NO: 101709 - DNA, 22 bp, Artificial Sequence
  Synthetic
gccaactacuggtgaatgcuga

SEQ ID NO: 101710 - DNA, 21 bp, Artificial Sequence
  Synthetic
gautgatgtggugcgcacaat

SEQ ID NO: 101711 - DNA, 26 bp, Artificial Sequence
  Synthetic
actaaaacgacccacutgttctguag

SEQ ID NO: 101712 - DNA, 22 bp, Artificial Sequence
  Synthetic
agaggaatgucagcgcatctut

SEQ ID NO: 101713 - DNA, 26 bp, Artificial Sequence
  Synthetic
gtcaaacttttaggugacctcctcut

SEQ ID NO: 101714 - DNA, 25 bp, Artificial Sequence
  Synthetic
tttggcttcuaaacagtctgtucct

SEQ ID NO: 101715 - DNA, 26 bp, Artificial Sequence
  Synthetic
gcacttttggagcutttgccaatuat

SEQ ID NO: 101716 - DNA, 22 bp, Artificial Sequence
  Synthetic
ctgatgctugttttgccgtuca

SEQ ID NO: 101717 - DNA, 27 bp, Artificial Sequence
  Synthetic
gcuagtaaaaagacugacaaagcagga

SEQ ID NO: 101718 - DNA, 20 bp, Artificial Sequence
  Synthetic
gagtggccugtgttguccat

SEQ ID NO: 101719 - DNA, 19 bp, Artificial Sequence
  Synthetic
gtcaugcaggcggcaatuc

SEQ ID NO: 101720 - DNA, 24 bp, Artificial Sequence
  Synthetic
tgtgttgcuaaatccatggcucat

SEQ ID NO: 101721 - DNA, 26 bp, Artificial Sequence
  Synthetic
aattaaagtaccguctgctctcacug

SEQ ID NO: 101722 - DNA, 23 bp, Artificial Sequence
  Synthetic
aatgagcacuagtcgaggtcuct

SEQ ID NO: 101723 - DNA, 20 bp, Artificial Sequence
  Synthetic
gacatgguctggatgcugct

SEQ ID NO: 101724 - DNA, 24 bp, Artificial Sequence
  Synthetic
catcctcaguagcttcaaaccuct

SEQ ID NO: 101725 - DNA, 23 bp, Artificial Sequence
  Synthetic
ccaccguccacttugaaagaaaa

SEQ ID NO: 101726 - DNA, 22 bp, Artificial Sequence
  Synthetic
agaacaucgacgatgaguccct

SEQ ID NO: 101727 - DNA, 24 bp, Artificial Sequence
  Synthetic
tgcaggauggatgatactcucaga

SEQ ID NO: 101728 - DNA, 22 bp, Artificial Sequence
  Synthetic
agcuttgactcugcaagaacca

SEQ ID NO: 101729 - DNA, 27 bp, Artificial Sequence
  Synthetic
acaggttaaguaagcatcagttctgut

SEQ ID NO: 101730 - DNA, 23 bp, Artificial Sequence
  Synthetic
ggaattggcuctggcaactgtua

SEQ ID NO: 101731 - DNA, 22 bp, Artificial Sequence
  Synthetic
gttttcgcggagugtttguagg

SEQ ID NO: 101732 - DNA, 22 bp, Artificial Sequence
  Synthetic
aaatcatcacucggccaaugga

SEQ ID NO: 101733 - DNA, 27 bp, Artificial Sequence
  Synthetic
tgcaatcacggaacauttgattctuac

SEQ ID NO: 101734 - DNA, 22 bp, Artificial Sequence
  Synthetic
aaauggcccaaaactcugacct

SEQ ID NO: 101735 - DNA, 23 bp, Artificial Sequence
  Synthetic
gctcaauggcacgatuaccagaa

SEQ ID NO: 101736 - DNA, 28 bp, Artificial Sequence
  Synthetic
gtgcttcatgaugttgacatattcctut

SEQ ID NO: 101737 - DNA, 22 bp, Artificial Sequence
  Synthetic
cttgaguaccaaggccactcug

SEQ ID NO: 101738 - DNA, 18 bp, Artificial Sequence
  Synthetic
gtggacucagcgcagugt

SEQ ID NO: 101739 - DNA, 24 bp, Artificial Sequence
  Synthetic
ggagaagtugaatgatcagcugga

SEQ ID NO: 101740 - DNA, 27 bp, Artificial Sequence
  Synthetic
atcaattcaauaacctcttccctugct

SEQ ID NO: 101741 - DNA, 25 bp, Artificial Sequence
  Synthetic
acaccagagcutcgtgtagaaauac

SEQ ID NO: 101742 - DNA, 22 bp, Artificial Sequence
  Synthetic
gtggtggcutctggtctctuat

SEQ ID NO: 101743 - DNA, 23 bp, Artificial Sequence
  Synthetic
ggctgttguacagttccttccuc

SEQ ID NO: 101744 - DNA, 23 bp, Artificial Sequence
  Synthetic
ggagcaaccaagacauctctugt

SEQ ID NO: 101745 - DNA, 22 bp, Artificial Sequence
  Synthetic
agcagcauggctccagattuag

SEQ ID NO: 101746 - DNA, 24 bp, Artificial Sequence
  Synthetic
ggagatggugatcttgcagaugaa

SEQ ID NO: 101747 - DNA, 22 bp, Artificial Sequence
  Synthetic
agaagcaatggutgaggccuac

SEQ ID NO: 101748 - DNA, 27 bp, Artificial Sequence
  Synthetic
acctatauccaagctcattuagacggt

SEQ ID NO: 101749 - DNA, 24 bp, Artificial Sequence
  Synthetic
agaaattcacugcgcacttugaaa

SEQ ID NO: 101750 - DNA, 22 bp, Artificial Sequence
  Synthetic
gaaatgggugagtggaggacut

SEQ ID NO: 101751 - DNA, 22 bp, Artificial Sequence
  Synthetic
cgaaggtcugcatctgttccug

SEQ ID NO: 101752 - DNA, 22 bp, Artificial Sequence
  Synthetic
cagccagugaagaagacaguga

SEQ ID NO: 101753 - DNA, 28 bp, Artificial Sequence
  Synthetic
ttccaactctauacaaagcccctaguat

SEQ ID NO: 101754 - DNA, 27 bp, Artificial Sequence
  Synthetic
tttctcaaataaccugcataccgtcut

SEQ ID NO: 101755 - DNA, 23 bp, Artificial Sequence
  Synthetic
ggatttaggutgaggtgguggag

SEQ ID NO: 101756 - DNA, 23 bp, Artificial Sequence
  Synthetic
cccgtgttcutcctgttcaucat

SEQ ID NO: 101757 - DNA, 29 bp, Artificial Sequence
  Synthetic
caaattctctauagttagtggtctucgca

SEQ ID NO: 101758 - DNA, 26 bp, Artificial Sequence
  Synthetic
gccatgacaaggaautctttttcugt

SEQ ID NO: 101759 - DNA, 28 bp, Artificial Sequence
  Synthetic
cagctattcaaucggatcaactctctut

SEQ ID NO: 101760 - DNA, 25 bp, Artificial Sequence
  Synthetic
cttcttcucaagacaaggactggua

SEQ ID NO: 101761 - DNA, 22 bp, Artificial Sequence
  Synthetic
cgtcgttcaugacgaggtaugg

SEQ ID NO: 101762 - DNA, 21 bp, Artificial Sequence
  Synthetic
agggcacacaagugttgacuc

SEQ ID NO: 101763 - DNA, 26 bp, Artificial Sequence
  Synthetic
gagtgggcatautttcacctcttcua

SEQ ID NO: 101764 - DNA, 22 bp, Artificial Sequence
  Synthetic
gggacacaauggcaagatcuac

SEQ ID NO: 101765 - DNA, 21 bp, Artificial Sequence
  Synthetic
cctcttgguggtctccttuct

SEQ ID NO: 101766 - DNA, 22 bp, Artificial Sequence
  Synthetic
gcugaacccctgttuggagaag

SEQ ID NO: 101767 - DNA, 21 bp, Artificial Sequence
  Synthetic
acccucaaaggctaacgugag

SEQ ID NO: 101768 - DNA, 28 bp, Artificial Sequence
  Synthetic
acagtttctucagaaatcctgcttucat

SEQ ID NO: 101769 - DNA, 28 bp, Artificial Sequence
  Synthetic
tgtttttagggaaaauggagctgauagt

SEQ ID NO: 101770 - DNA, 27 bp, Artificial Sequence
  Synthetic
agatccaggatacuatcagctccatut

SEQ ID NO: 101771 - DNA, 27 bp, Artificial Sequence
  Synthetic
caggtgcatuggatatttattgacucc

SEQ ID NO: 101772 - DNA, 28 bp, Artificial Sequence
  Synthetic
taaggctugagacactttgtatttaugt

SEQ ID NO: 101773 - DNA, 26 bp, Artificial Sequence
  Synthetic
gtctgcaaauagcataagagcaacug

SEQ ID NO: 101774 - DNA, 25 bp, Artificial Sequence
  Synthetic
tgcagacaggaggacuatctttuca

SEQ ID NO: 101775 - DNA, 28 bp, Artificial Sequence
  Synthetic
gccttacagaaaugcccaggtatttuat

SEQ ID NO: 101776 - DNA, 23 bp, Artificial Sequence
  Synthetic
ctctgtttugagcttccgguaga

SEQ ID NO: 101777 - DNA, 20 bp, Artificial Sequence
  Synthetic
gcagtgauggtagctgcugt

SEQ ID NO: 101778 - DNA, 21 bp, Artificial Sequence
  Synthetic
tctgtguaacagcagcauggt

SEQ ID NO: 101779 - DNA, 19 bp, Artificial Sequence
  Synthetic
gatgccatugccagcguag

SEQ ID NO: 101780 - DNA, 25 bp, Artificial Sequence
  Synthetic
caccaattcatguacacgacaggua

SEQ ID NO: 101781 - DNA, 22 bp, Artificial Sequence
  Synthetic
aagtaauggcccaggtaaucgg

SEQ ID NO: 101782 - DNA, 26 bp, Artificial Sequence
  Synthetic
cacattacctucggctacttgaugat

SEQ ID NO: 101783 - DNA, 27 bp, Artificial Sequence
  Synthetic
agcgttcugaaagaaatacattugcag

SEQ ID NO: 101784 - DNA, 27 bp, Artificial Sequence
  Synthetic
actgttgttttauttccggtctauggg

SEQ ID NO: 101785 - DNA, 23 bp, Artificial Sequence
  Synthetic
ccautgatgtugccgaaaaggaa

SEQ ID NO: 101786 - DNA, 20 bp, Artificial Sequence
  Synthetic
ccactauagcgaccccaugt

SEQ ID NO: 101787 - DNA, 21 bp, Artificial Sequence
  Synthetic
cacacaaaggaccuggctcua

SEQ ID NO: 101788 - DNA, 21 bp, Artificial Sequence
  Synthetic
ccucaacagcagaaagcctut

SEQ ID NO: 101789 - DNA, 33 bp, Artificial Sequence
  Synthetic
tagagattagtgttuagtggactatacatacuc

SEQ ID NO: 101790 - DNA, 21 bp, Artificial Sequence
  Synthetic
gaggcggcccautttcttuag

SEQ ID NO: 101791 - DNA, 21 bp, Artificial Sequence
  Synthetic
gcacctccutcctctgctuag

SEQ ID NO: 101792 - DNA, 24 bp, Artificial Sequence
  Synthetic
ccctcuaaagaacagcttgtccua

SEQ ID NO: 101793 - DNA, 21 bp, Artificial Sequence
  Synthetic
ttgutgaggctaucgcaggag

SEQ ID NO: 101794 - DNA, 21 bp, Artificial Sequence
  Synthetic
ctgtggcaauggaatucagca

SEQ ID NO: 101795 - DNA, 23 bp, Artificial Sequence
  Synthetic
gacaacaaggacaggucagtuct

SEQ ID NO: 101796 - DNA, 19 bp, Artificial Sequence
  Synthetic
ggucccugagagccagagt

SEQ ID NO: 101797 - DNA, 18 bp, Artificial Sequence
  Synthetic
gccctaguggtgcugaca

SEQ ID NO: 101798 - DNA, 20 bp, Artificial Sequence
  Synthetic
atgcuaaggccccucagaac

SEQ ID NO: 101799 - DNA, 22 bp, Artificial Sequence
  Synthetic
tcaatagcttgugccgcaagua

SEQ ID NO: 101800 - DNA, 24 bp, Artificial Sequence
  Synthetic
gcatcugggataactacuccccat

SEQ ID NO: 101801 - DNA, 22 bp, Artificial Sequence
  Synthetic
acagcagcaauacgaggacauc

SEQ ID NO: 101802 - DNA, 27 bp, Artificial Sequence
  Synthetic
gtttctttaucagaccagtcatugcac

SEQ ID NO: 101803 - DNA, 28 bp, Artificial Sequence
  Synthetic
aaagaacutcaaagucaacaaagcaaca

SEQ ID NO: 101804 - DNA, 21 bp, Artificial Sequence
  Synthetic
tctctcctucgccctcctuag

SEQ ID NO: 101805 - DNA, 23 bp, Artificial Sequence
  Synthetic
tgcattcttcucgcactcttcut

SEQ ID NO: 101806 - DNA, 22 bp, Artificial Sequence
  Synthetic
cttcctgaguagccgatgagut

SEQ ID NO: 101807 - DNA, 21 bp, Artificial Sequence
  Synthetic
gctctctugacccagctcuct

SEQ ID NO: 101808 - DNA, 23 bp, Artificial Sequence
  Synthetic
gtggauggagacgggaaatttug

SEQ ID NO: 101809 - DNA, 22 bp, Artificial Sequence
  Synthetic
gatgcgatucacatgctggaut

SEQ ID NO: 101810 - DNA, 29 bp, Artificial Sequence
  Synthetic
actgattgtgggutaagatggtattugaa

SEQ ID NO: 101811 - DNA, 20 bp, Artificial Sequence
  Synthetic
tctcttggugttggctucgt

SEQ ID NO: 101812 - DNA, 20 bp, Artificial Sequence
  Synthetic
ggatgtcggguggcagtaug

SEQ ID NO: 101813 - DNA, 26 bp, Artificial Sequence
  Synthetic
cagctcgaaaaccauttctgtcatut

SEQ ID NO: 101814 - DNA, 28 bp, Artificial Sequence
  Synthetic
aacgtttggaaaucttttctaccuacct

SEQ ID NO: 101815 - DNA, 26 bp, Artificial Sequence
  Synthetic
tcttcatcucgaaacgtgcgauaaat

SEQ ID NO: 101816 - DNA, 20 bp, Artificial Sequence
  Synthetic
ccacuggacgctgtcucaag

SEQ ID NO: 101817 - DNA, 28 bp, Artificial Sequence
  Synthetic
aaggaagtgguaaatcaaactcacauga

SEQ ID NO: 101818 - DNA, 27 bp, Artificial Sequence
  Synthetic
attcttggtcutaatggcgaguaacaa

SEQ ID NO: 101819 - DNA, 25 bp, Artificial Sequence
  Synthetic
ccucaatcacaauaagaccaccaga

SEQ ID NO: 101820 - DNA, 27 bp, Artificial Sequence
  Synthetic
gtatttgcaguaggaagatgttgguca

SEQ ID NO: 101821 - DNA, 28 bp, Artificial Sequence
  Synthetic
ggctttgtgtatauactgccagagtuaa

SEQ ID NO: 101822 - DNA, 22 bp, Artificial Sequence
  Synthetic
ggagctgugtttcaaccttucc

SEQ ID NO: 101823 - DNA, 27 bp, Artificial Sequence
  Synthetic
tgtgactguaagtgaaagtgaaucagt

SEQ ID NO: 101824 - DNA, 24 bp, Artificial Sequence
  Synthetic
gggtaugacagcattaactuccat

SEQ ID NO: 101825 - DNA, 29 bp, Artificial Sequence
  Synthetic
attcctcuaaacagattcucaaacagaaa

SEQ ID NO: 101826 - DNA, 28 bp, Artificial Sequence
  Synthetic
cgtggatgatguaatgaaggattcttug

SEQ ID NO: 101827 - DNA, 22 bp, Artificial Sequence
  Synthetic
ggctgucagcaguaaaggagaa

SEQ ID NO: 101828 - DNA, 25 bp, Artificial Sequence
  Synthetic
gacagccagaagutcagaauacaga

SEQ ID NO: 101829 - DNA, 29 bp, Artificial Sequence
  Synthetic
tgatgaagtgatuaaagtgacagtgtuca

SEQ ID NO: 101830 - DNA, 23 bp, Artificial Sequence
  Synthetic
agttttgauccgaacctcgugaa

SEQ ID NO: 101831 - DNA, 22 bp, Artificial Sequence
  Synthetic
gactcctucagcatcttccugt

SEQ ID NO: 101832 - DNA, 20 bp, Artificial Sequence
  Synthetic
cggtaagttuggcggcagua

SEQ ID NO: 101833 - DNA, 23 bp, Artificial Sequence
  Synthetic
gaaacgacatugtcacagagcut

SEQ ID NO: 101834 - DNA, 26 bp, Artificial Sequence
  Synthetic
tgtggaagatugctgtgttctgtuat

SEQ ID NO: 101835 - DNA, 22 bp, Artificial Sequence
  Synthetic
cgtaaagguacgagugacggaa

SEQ ID NO: 101836 - DNA, 24 bp, Artificial Sequence
  Synthetic
caaagcugccctgttauaaaagcc

SEQ ID NO: 101837 - DNA, 26 bp, Artificial Sequence
  Synthetic
ttttctatagaccucctgtggucagt

SEQ ID NO: 101838 - DNA, 24 bp, Artificial Sequence
  Synthetic
tcttuatccagagcucagcagaga

SEQ ID NO: 101839 - DNA, 21 bp, Artificial Sequence
  Synthetic
gtagcgtucccgctgttcuat

SEQ ID NO: 101840 - DNA, 21 bp, Artificial Sequence
  Synthetic
accctguacctgacccugaaa

SEQ ID NO: 101841 - DNA, 20 bp, Artificial Sequence
  Synthetic
gatuggccacggctaugagt

SEQ ID NO: 101842 - DNA, 23 bp, Artificial Sequence
  Synthetic
gacgaggaaaagautggcucaga

SEQ ID NO: 101843 - DNA, 19 bp, Artificial Sequence
  Synthetic
atcagaucgcaccggugac

SEQ ID NO: 101844 - DNA, 26 bp, Artificial Sequence
  Synthetic
tgaatattggguaccaaggagccaua

SEQ ID NO: 101845 - DNA, 28 bp, Artificial Sequence
  Synthetic
cacattaagaaaaugggagcgattugaa

SEQ ID NO: 101846 - DNA, 27 bp, Artificial Sequence
  Synthetic
ttcatgacuggaacctgttugaaaaag

SEQ ID NO: 101847 - DNA, 25 bp, Artificial Sequence
  Synthetic
tgaaagutgacagtttugcaaacga

SEQ ID NO: 101848 - DNA, 25 bp, Artificial Sequence
  Synthetic
ggagctttgcutctagaacttugct

SEQ ID NO: 101849 - DNA, 29 bp, Artificial Sequence
  Synthetic
ccattcaatgttutggatttgcttcugat

SEQ ID NO: 101850 - DNA, 25 bp, Artificial Sequence
  Synthetic
gcctgacttcutttctactggtgua

SEQ ID NO: 101851 - DNA, 22 bp, Artificial Sequence
  Synthetic
actcagcaauctgtgacagucc

SEQ ID NO: 101852 - DNA, 28 bp, Artificial Sequence
  Synthetic
actcagggaaaaaugaatttacgtgcua

SEQ ID NO: 101853 - DNA, 21 bp, Artificial Sequence
  Synthetic
acucaggagccagaggaugag

SEQ ID NO: 101854 - DNA, 25 bp, Artificial Sequence
  Synthetic
gaaatacctcugcaagagauccact

SEQ ID NO: 101855 - DNA, 20 bp, Artificial Sequence
  Synthetic
acccuggacccactcaucaa

SEQ ID NO: 101856 - DNA, 21 bp, Artificial Sequence
  Synthetic
ggaccattuccagctcttgug

SEQ ID NO: 101857 - DNA, 29 bp, Artificial Sequence
  Synthetic
aggtgagtagaagauagggatgaaatgut

SEQ ID NO: 101858 - DNA, 23 bp, Artificial Sequence
  Synthetic
gttctaggtcutctttgccggut

SEQ ID NO: 101859 - DNA, 20 bp, Artificial Sequence
  Synthetic
tgutacagcuggcaggcaat

SEQ ID NO: 101860 - DNA, 19 bp, Artificial Sequence
  Synthetic
tctgcgcuctccacgtcua

SEQ ID NO: 101861 - DNA, 27 bp, Artificial Sequence
  Synthetic
ggagagttgautatgtttgcaatugct

SEQ ID NO: 101862 - DNA, 24 bp, Artificial Sequence
  Synthetic
gatcctccuttctagcattuggct

SEQ ID NO: 101863 - DNA, 21 bp, Artificial Sequence
  Synthetic
tttgaagugcctctggcugaa

SEQ ID NO: 101864 - DNA, 21 bp, Artificial Sequence
  Synthetic
cctgcaacagaugtggcugat

SEQ ID NO: 101865 - DNA, 23 bp, Artificial Sequence
  Synthetic
gaaacuggccaaaaccatccaut

SEQ ID NO: 101866 - DNA, 22 bp, Artificial Sequence
  Synthetic
catggaguctgaacgucggaaa

SEQ ID NO: 101867 - DNA, 27 bp, Artificial Sequence
  Synthetic
gttaaaggtcugttaccctaauccagt

SEQ ID NO: 101868 - DNA, 24 bp, Artificial Sequence
  Synthetic
aggaagttugcagcacagaagaua

SEQ ID NO: 101869 - DNA, 23 bp, Artificial Sequence
  Synthetic
agcuttgcaguccaaaaggaaac

SEQ ID NO: 101870 - DNA, 23 bp, Artificial Sequence
  Synthetic
ccatcagcuctgtatggaacugg

SEQ ID NO: 101871 - DNA, 25 bp, Artificial Sequence
  Synthetic
agttgctgacutctttcttccugaa

SEQ ID NO: 101872 - DNA, 20 bp, Artificial Sequence
  Synthetic
ctcccaugggccaacugaaa

SEQ ID NO: 101873 - DNA, 27 bp, Artificial Sequence
  Synthetic
tgggacatggagutgttaaaagaauct

SEQ ID NO: 101874 - DNA, 26 bp, Artificial Sequence
  Synthetic
ttgcaactcucaaggcctauaaacat

SEQ ID NO: 101875 - DNA, 25 bp, Artificial Sequence
  Synthetic
cgaattggagaucaggcttctgtuc

SEQ ID NO: 101876 - DNA, 25 bp, Artificial Sequence
  Synthetic
acctgacagtcuttcagtgcattut

SEQ ID NO: 101877 - DNA, 23 bp, Artificial Sequence
  Synthetic
tgtgtttgtucagatccagcugt

SEQ ID NO: 101878 - DNA, 24 bp, Artificial Sequence
  Synthetic
tcaggaaattcuccctgctcuact

SEQ ID NO: 101879 - DNA, 24 bp, Artificial Sequence
  Synthetic
cacccagcauatcataccacaguc

SEQ ID NO: 101880 - DNA, 25 bp, Artificial Sequence
  Synthetic
gaccaagatuccaataagcctucca

SEQ ID NO: 101881 - DNA, 31 bp, Artificial Sequence
  Synthetic
ttcttaattuggagaaaatactggcuagaat

SEQ ID NO: 101882 - DNA, 19 bp, Artificial Sequence
  Synthetic
tggctgaguggcgttaugg

SEQ ID NO: 101883 - DNA, 27 bp, Artificial Sequence
  Synthetic
attcctttctuacataccagtgtugct

SEQ ID NO: 101884 - DNA, 18 bp, Artificial Sequence
  Synthetic
ccgaccugtgccctucaa

SEQ ID NO: 101885 - DNA, 21 bp, Artificial Sequence
  Synthetic
acgacctucctcttccuccag

SEQ ID NO: 101886 - DNA, 20 bp, Artificial Sequence
  Synthetic
agucttgtccugggaccgaa

SEQ ID NO: 101887 - DNA, 23 bp, Artificial Sequence
  Synthetic
catctgccauggacatgcaaauc

SEQ ID NO: 101888 - DNA, 22 bp, Artificial Sequence
  Synthetic
agcaggucaccttaattuggct

SEQ ID NO: 101889 - DNA, 28 bp, Artificial Sequence
  Synthetic
tgggatcatttuggcagtaatttugaga

SEQ ID NO: 101890 - DNA, 25 bp, Artificial Sequence
  Synthetic
aaaaccacuttaccttaugccgagt

SEQ ID NO: 101891 - DNA, 28 bp, Artificial Sequence
  Synthetic
gattaattttctucagtctgtggtugct

SEQ ID NO: 101892 - DNA, 25 bp, Artificial Sequence
  Synthetic
ggcaugattttaattcucccacaca

SEQ ID NO: 101893 - DNA, 28 bp, Artificial Sequence
  Synthetic
cagacagaacaaaagutagcaguagaga

SEQ ID NO: 101894 - DNA, 24 bp, Artificial Sequence
  Synthetic
cagctcatcaaautgctggtgtuc

SEQ ID NO: 101895 - DNA, 23 bp, Artificial Sequence
  Synthetic
tgcccttggguaagcttaatucc

SEQ ID NO: 101896 - DNA, 25 bp, Artificial Sequence
  Synthetic
aatgtgatgautcttcggtaugcca

SEQ ID NO: 101897 - DNA, 22 bp, Artificial Sequence
  Synthetic
gugttcatgaucaagggcacaa

SEQ ID NO: 101898 - DNA, 24 bp, Artificial Sequence
  Synthetic
tcucagttauccagacggacagag

SEQ ID NO: 101899 - DNA, 28 bp, Artificial Sequence
  Synthetic
tggtgattucaaggaaaatgtgttgtug

SEQ ID NO: 101900 - DNA, 23 bp, Artificial Sequence
  Synthetic
catccacaaugttgttgcugagt

SEQ ID NO: 101901 - DNA, 24 bp, Artificial Sequence
  Synthetic
ttttacttggaauccaggcacugt

SEQ ID NO: 101902 - DNA, 27 bp, Artificial Sequence
  Synthetic
ccaaaaggtgcugataatttccugaaa

SEQ ID NO: 101903 - DNA, 23 bp, Artificial Sequence
  Synthetic
cattgttcctugccctttgtuct

SEQ ID NO: 101904 - DNA, 23 bp, Artificial Sequence
  Synthetic
ctttgcctuaataaacccgugct

SEQ ID NO: 101905 - DNA, 24 bp, Artificial Sequence
  Synthetic
gacctgaagcagcaautactgtug

SEQ ID NO: 101906 - DNA, 27 bp, Artificial Sequence
  Synthetic
cacccagcguacatacatttuaaaaca

SEQ ID NO: 101907 - DNA, 24 bp, Artificial Sequence
  Synthetic
attttatacuccaaggccuggcaa

SEQ ID NO: 101908 - DNA, 28 bp, Artificial Sequence
  Synthetic
gttcttttaccugccaatgtttcugaaa

SEQ ID NO: 101909 - DNA, 23 bp, Artificial Sequence
  Synthetic
cagatgatggugatgacaaugcc

SEQ ID NO: 101910 - DNA, 28 bp, Artificial Sequence
  Synthetic
agacatacttgcutgacttccauaaaca

SEQ ID NO: 101911 - DNA, 27 bp, Artificial Sequence
  Synthetic
cgaaatttaccucattggatucagcag

SEQ ID NO: 101912 - DNA, 22 bp, Artificial Sequence
  Synthetic
cagcatcgtucatggcagtaug

SEQ ID NO: 101913 - DNA, 31 bp, Artificial Sequence
  Synthetic
tcctactttagucactttcatatcagucact

SEQ ID NO: 101914 - DNA, 25 bp, Artificial Sequence
  Synthetic
tcctctttucccaggttgguaaaac

SEQ ID NO: 101915 - DNA, 27 bp, Artificial Sequence
  Synthetic
gggcttactcuctgatattctctgtua

SEQ ID NO: 101916 - DNA, 25 bp, Artificial Sequence
  Synthetic
acatggtaagagguaaaggaccugt

SEQ ID NO: 101917 - DNA, 28 bp, Artificial Sequence
  Synthetic
ggaagaaaggtucaatacggaaaactug

SEQ ID NO: 101918 - DNA, 25 bp, Artificial Sequence
  Synthetic
ctcaggaatgugctgtttactcuct

SEQ ID NO: 101919 - DNA, 28 bp, Artificial Sequence
  Synthetic
acaagcatguaagaatttctcuaaggca

SEQ ID NO: 101920 - DNA, 21 bp, Artificial Sequence
  Synthetic
ggagtttucaccccaacccut

SEQ ID NO: 101921 - DNA, 21 bp, Artificial Sequence
  Synthetic
gccccggugagttcaaagaug

SEQ ID NO: 101922 - DNA, 24 bp, Artificial Sequence
  Synthetic
cagctguacatcgactgugaaaag

SEQ ID NO: 101923 - DNA, 20 bp, Artificial Sequence
  Synthetic
cagaugaucccacggagcag

SEQ ID NO: 101924 - DNA, 21 bp, Artificial Sequence
  Synthetic
cggagacaacagcgugttuga

SEQ ID NO: 101925 - DNA, 22 bp, Artificial Sequence
  Synthetic
tggaacutgtcaucaggcacag

SEQ ID NO: 101926 - DNA, 20 bp, Artificial Sequence
  Synthetic
cagcuttccgcaucgaggat

SEQ ID NO: 101927 - DNA, 20 bp, Artificial Sequence
  Synthetic
gagtgguctttccgcuccag

SEQ ID NO: 101928 - DNA, 22 bp, Artificial Sequence
  Synthetic
agtgagtgagaugggagtguca

SEQ ID NO: 101929 - DNA, 23 bp, Artificial Sequence
  Synthetic
ggatggugaacatctuccggaac

SEQ ID NO: 101930 - DNA, 22 bp, Artificial Sequence
  Synthetic
cccugaggcagaugaagaagac

SEQ ID NO: 101931 - DNA, 22 bp, Artificial Sequence
  Synthetic
gagagcutctuccacagacacc

SEQ ID NO: 101932 - DNA, 20 bp, Artificial Sequence
  Synthetic
gccugaccguccaaggaaag

SEQ ID NO: 101933 - DNA, 22 bp, Artificial Sequence
  Synthetic
cgtccaacucagcattcuccat

SEQ ID NO: 101934 - DNA, 20 bp, Artificial Sequence
  Synthetic
aatgccacggacuacuggac

SEQ ID NO: 101935 - DNA, 23 bp, Artificial Sequence
  Synthetic
atctggctgtucaaagcaggtua

SEQ ID NO: 101936 - DNA, 26 bp, Artificial Sequence
  Synthetic
accatacacgutttggttttctguct

SEQ ID NO: 101937 - DNA, 20 bp, Artificial Sequence
  Synthetic
tgccgcucctucacaaagat

SEQ ID NO: 101938 - DNA, 19 bp, Artificial Sequence
  Synthetic
gggcgacuaccuggagaac

SEQ ID NO: 101939 - DNA, 21 bp, Artificial Sequence
  Synthetic
gcctctggucaaagctcgtut

SEQ ID NO: 101940 - DNA, 25 bp, Artificial Sequence
  Synthetic
aacagtgttgaguttaggaggcaut

SEQ ID NO: 101941 - DNA, 22 bp, Artificial Sequence
  Synthetic
tctccagaagutggacgtcuca

SEQ ID NO: 101942 - DNA, 21 bp, Artificial Sequence
  Synthetic
gagagagcugctcctugagac

SEQ ID NO: 101943 - DNA, 27 bp, Artificial Sequence
  Synthetic
ttattcttccccuatggctttgaacut

SEQ ID NO: 101944 - DNA, 28 bp, Artificial Sequence
  Synthetic
ctgcaatttacccuccatttacatcuct

SEQ ID NO: 101945 - DNA, 22 bp, Artificial Sequence
  Synthetic
ccatcttugtcatggucagcct

SEQ ID NO: 101946 - DNA, 20 bp, Artificial Sequence
  Synthetic
ctatgugcccaaugccaacc

SEQ ID NO: 101947 - DNA, 23 bp, Artificial Sequence
  Synthetic
gtcttagaaaguggctcccauga

SEQ ID NO: 101948 - DNA, 27 bp, Artificial Sequence
  Synthetic
cttttagtaatagcutccccagtgcut

SEQ ID NO: 101949 - DNA, 28 bp, Artificial Sequence
  Synthetic
gggagaatctguccttcagaatactuct

SEQ ID NO: 101950 - DNA, 23 bp, Artificial Sequence
  Synthetic
tgaatagtgggaaugccttcugg

SEQ ID NO: 101951 - DNA, 28 bp, Artificial Sequence
  Synthetic
tgacaaaggacutctgtatgtgtttuca

SEQ ID NO: 101952 - DNA, 18 bp, Artificial Sequence
  Synthetic
acggcgagautcgaccug

SEQ ID NO: 101953 - DNA, 20 bp, Artificial Sequence
  Synthetic
caaacgcaagucgtggauga

SEQ ID NO: 101954 - DNA, 21 bp, Artificial Sequence
  Synthetic
ccaccutactcauccacgact

SEQ ID NO: 101955 - DNA, 17 bp, Artificial Sequence
  Synthetic
caggcagcagccucuct

SEQ ID NO: 101956 - DNA, 25 bp, Artificial Sequence
  Synthetic
gtctaaggatugacagacacucagg

SEQ ID NO: 101957 - DNA, 24 bp, Artificial Sequence
  Synthetic
cattgcacagaacauggttucaca

SEQ ID NO: 101958 - DNA, 28 bp, Artificial Sequence
  Synthetic
gaggaagcattcugatttcacatttcuc

SEQ ID NO: 101959 - DNA, 28 bp, Artificial Sequence
  Synthetic
gccttgacauccctactatagataucca

SEQ ID NO: 101960 - DNA, 25 bp, Artificial Sequence
  Synthetic
gggcaaattaautcccacctuaact

SEQ ID NO: 101961 - DNA, 24 bp, Artificial Sequence
  Synthetic
ggaagagaucaagcacctgaaguc

SEQ ID NO: 101962 - DNA, 23 bp, Artificial Sequence
  Synthetic
cttgcagguaaatccagagcuca

SEQ ID NO: 101963 - DNA, 28 bp, Artificial Sequence
  Synthetic
gctggaaagtuccatctctgattcatua

SEQ ID NO: 101964 - DNA, 28 bp, Artificial Sequence
  Synthetic
ggacagaagagaauctatccaaacugaa

SEQ ID NO: 101965 - DNA, 20 bp, Artificial Sequence
  Synthetic
gggaugcaagagggaugacc

SEQ ID NO: 101966 - DNA, 22 bp, Artificial Sequence
  Synthetic
cggccactuacagctgacauaa

SEQ ID NO: 101967 - DNA, 33 bp, Artificial Sequence
  Synthetic
ttgttttatcaugaacatttataaucaggaagg

SEQ ID NO: 101968 - DNA, 17 bp, Artificial Sequence
  Synthetic
ggcugggtgcucaccat

SEQ ID NO: 101969 - DNA, 17 bp, Artificial Sequence
  Synthetic
cccaggcugcctuggac

SEQ ID NO: 101970 - DNA, 20 bp, Artificial Sequence
  Synthetic
ttggtggagaagutggccut

SEQ ID NO: 101971 - DNA, 17 bp, Artificial Sequence
  Synthetic
cgcuaccagcgctucct

SEQ ID NO: 101972 - DNA, 17 bp, Artificial Sequence
  Synthetic
cgcaggaagcgcuggua

SEQ ID NO: 101973 - DNA, 20 bp, Artificial Sequence
  Synthetic
cuttgccucagaccccaagt

SEQ ID NO: 101974 - DNA, 23 bp, Artificial Sequence
  Synthetic
aagtaatagugggtgctgcugac

SEQ ID NO: 101975 - DNA, 21 bp, Artificial Sequence
  Synthetic
tctcaagcucaccugggaaga

SEQ ID NO: 101976 - DNA, 25 bp, Artificial Sequence
  Synthetic
cagatctcaaagucatcctcaucct

SEQ ID NO: 101977 - DNA, 17 bp, Artificial Sequence
  Synthetic
gccauggacgcctgcuc

SEQ ID NO: 101978 - DNA, 17 bp, Artificial Sequence
  Synthetic
gggcuccucaccgaagt

SEQ ID NO: 101979 - DNA, 19 bp, Artificial Sequence
  Synthetic
cugugagcgaggaccaaga

SEQ ID NO: 101980 - DNA, 21 bp, Artificial Sequence
  Synthetic
cctctugaagtcgcuggacaa

SEQ ID NO: 101981 - DNA, 21 bp, Artificial Sequence
  Synthetic
gacactuggctttctcuccca

SEQ ID NO: 101982 - DNA, 23 bp, Artificial Sequence
  Synthetic
tgaacagtggauactctggguga

SEQ ID NO: 101983 - DNA, 22 bp, Artificial Sequence
  Synthetic
actgatgccgagugtgactcua

SEQ ID NO: 101984 - DNA, 21 bp, Artificial Sequence
  Synthetic
ggtttctcguagcctgctgua

SEQ ID NO: 101985 - DNA, 25 bp, Artificial Sequence
  Synthetic
gttgaataaagccugttacgtuccc

SEQ ID NO: 101986 - DNA, 28 bp, Artificial Sequence
  Synthetic
aaattttacaucacagccctctaagugt

SEQ ID NO: 101987 - DNA, 27 bp, Artificial Sequence
  Synthetic
ctaaagtcttggcucatggaactatug

SEQ ID NO: 101988 - DNA, 23 bp, Artificial Sequence
  Synthetic
agctttccuccaaggttgttugt

SEQ ID NO: 101989 - DNA, 21 bp, Artificial Sequence
  Synthetic
cucgagcagagtuggagaagg

SEQ ID NO: 101990 - DNA, 21 bp, Artificial Sequence
  Synthetic
agctggcutgcagaatuccat

SEQ ID NO: 101991 - DNA, 28 bp, Artificial Sequence
  Synthetic
agctcaagaaacugaggagtttacatut

SEQ ID NO: 101992 - DNA, 20 bp, Artificial Sequence
  Synthetic
ctcctgagcaauccgcagua

SEQ ID NO: 101993 - DNA, 28 bp, Artificial Sequence
  Synthetic
gagaaagcagcaucacattatgattgut

SEQ ID NO: 101994 - DNA, 23 bp, Artificial Sequence
  Synthetic
ttctttaccugacctuggcaaca

SEQ ID NO: 101995 - DNA, 24 bp, Artificial Sequence
  Synthetic
atgagtcttucaaggacacagcuc

SEQ ID NO: 101996 - DNA, 25 bp, Artificial Sequence
  Synthetic
gggctatttuaaatgccacaauggt

SEQ ID NO: 101997 - DNA, 28 bp, Artificial Sequence
  Synthetic
cccaagagactaaugagcaatacacaua

SEQ ID NO: 101998 - DNA, 28 bp, Artificial Sequence
  Synthetic
tcattaaactgtgutttcagctcctcut

SEQ ID NO: 101999 - DNA, 21 bp, Artificial Sequence
  Synthetic
ctccaguccatcctgtcugag

SEQ ID NO: 102000 - DNA, 26 bp, Artificial Sequence
  Synthetic
catccttgaauaacgctttguccaaa

SEQ ID NO: 102001 - DNA, 23 bp, Artificial Sequence
  Synthetic
gugaaaacagacauggagagcac

SEQ ID NO: 102002 - DNA, 27 bp, Artificial Sequence
  Synthetic
caggtgattatcutacatccagccaut

SEQ ID NO: 102003 - DNA, 29 bp, Artificial Sequence
  Synthetic
tgccaagaacaaaaugaatuacaaacaga

SEQ ID NO: 102004 - DNA, 28 bp, Artificial Sequence
  Synthetic
gataacaagtgttutcctttgctgguaa

SEQ ID NO: 102005 - DNA, 31 bp, Artificial Sequence
  Synthetic
atggttttaaacucatgacttatcacugact

SEQ ID NO: 102006 - DNA, 22 bp, Artificial Sequence
  Synthetic
tgtaactgcugacatccuccct

SEQ ID NO: 102007 - DNA, 21 bp, Artificial Sequence
  Synthetic
catgcgcuttgcattguccat

SEQ ID NO: 102008 - DNA, 21 bp, Artificial Sequence
  Synthetic
agggctcucgtgtgatctuct

SEQ ID NO: 102009 - DNA, 27 bp, Artificial Sequence
  Synthetic
ccaatggaaugactatguagagaggaa

SEQ ID NO: 102010 - DNA, 17 bp, Artificial Sequence
  Synthetic
ggccaggucagcaucca

SEQ ID NO: 102011 - DNA, 18 bp, Artificial Sequence
  Synthetic
ctgucggcccaggacauc

SEQ ID NO: 102012 - DNA, 22 bp, Artificial Sequence
  Synthetic
ctgtgtggaugaagctgttcug

SEQ ID NO: 102013 - DNA, 20 bp, Artificial Sequence
  Synthetic
gttcaccgugccatctcugt

SEQ ID NO: 102014 - DNA, 22 bp, Artificial Sequence
  Synthetic
gatgccctugtttggtgaucag

SEQ ID NO: 102015 - DNA, 26 bp, Artificial Sequence
  Synthetic
atgccaugaccaaagtattcttcugt

SEQ ID NO: 102016 - DNA, 21 bp, Artificial Sequence
  Synthetic
atccactgcuccaactggtut

SEQ ID NO: 102017 - DNA, 29 bp, Artificial Sequence
  Synthetic
ctttgtgattggtuttcagtagagatguc

SEQ ID NO: 102018 - DNA, 24 bp, Artificial Sequence
  Synthetic
gctgaagtucctaaagtgtcucct

SEQ ID NO: 102019 - DNA, 24 bp, Artificial Sequence
  Synthetic
cgatgguggtcagaaacucagaaa

SEQ ID NO: 102020 - DNA, 27 bp, Artificial Sequence
  Synthetic
agcauaaccaccaauagaaaacaggaa

SEQ ID NO: 102021 - DNA, 22 bp, Artificial Sequence
  Synthetic
ggaacagtucagtgcccttcug

SEQ ID NO: 102022 - DNA, 19 bp, Artificial Sequence
  Synthetic
tutcgacucacgcccaaca

SEQ ID NO: 102023 - DNA, 20 bp, Artificial Sequence
  Synthetic
gauaggacgacguggagacc

SEQ ID NO: 102024 - DNA, 21 bp, Artificial Sequence
  Synthetic
gttaactgcugagcccaggut

SEQ ID NO: 102025 - DNA, 24 bp, Artificial Sequence
  Synthetic
agacagugtatuccaaacgcagag

SEQ ID NO: 102026 - DNA, 22 bp, Artificial Sequence
  Synthetic
gcugaccaggttcuccaaacag

SEQ ID NO: 102027 - DNA, 20 bp, Artificial Sequence
  Synthetic
ctggcucccgaagugaaaca

SEQ ID NO: 102028 - DNA, 20 bp, Artificial Sequence
  Synthetic
acccacuggcagttgtgtuc

SEQ ID NO: 102029 - DNA, 27 bp, Artificial Sequence
  Synthetic
ctcttcagtuaccatggtgatatucca

SEQ ID NO: 102030 - DNA, 25 bp, Artificial Sequence
  Synthetic
acatcaguatcacacucacacacag

SEQ ID NO: 102031 - DNA, 21 bp, Artificial Sequence
  Synthetic
ctacgagccucagcucaacag

SEQ ID NO: 102032 - DNA, 26 bp, Artificial Sequence
  Synthetic
tgcactuacccacaaatacaatguga

SEQ ID NO: 102033 - DNA, 22 bp, Artificial Sequence
  Synthetic
catgcacagugtcuggaaggaa

SEQ ID NO: 102034 - DNA, 25 bp, Artificial Sequence
  Synthetic
tgctgagataaaugtcccaggatug

SEQ ID NO: 102035 - DNA, 26 bp, Artificial Sequence
  Synthetic
tcagtttgtuaccactggagaatcug

SEQ ID NO: 102036 - DNA, 23 bp, Artificial Sequence
  Synthetic
agctgcugagctttctcttucag

SEQ ID NO: 102037 - DNA, 22 bp, Artificial Sequence
  Synthetic
atttccaugttctcugggccaa

SEQ ID NO: 102038 - DNA, 21 bp, Artificial Sequence
  Synthetic
gcccauggacagtggaaacua

SEQ ID NO: 102039 - DNA, 22 bp, Artificial Sequence
  Synthetic
gagaaaaccggaaaugaugcca

SEQ ID NO: 102040 - DNA, 27 bp, Artificial Sequence
  Synthetic
tttgtgtcaacutggctttaatucgag

SEQ ID NO: 102041 - DNA, 28 bp, Artificial Sequence
  Synthetic
ctcagcctacautgtcatttttcttgut

SEQ ID NO: 102042 - DNA, 22 bp, Artificial Sequence
  Synthetic
cctgttccccuctcactctcut

SEQ ID NO: 102043 - DNA, 28 bp, Artificial Sequence
  Synthetic
tcactgaagaauagctatgccattugag

SEQ ID NO: 102044 - DNA, 20 bp, Artificial Sequence
  Synthetic
ggtggtcautgacctgcuca

SEQ ID NO: 102045 - DNA, 24 bp, Artificial Sequence
  Synthetic
gatctctcccutgtctcctctcut

SEQ ID NO: 102046 - DNA, 22 bp, Artificial Sequence
  Synthetic
ctggcagaaagcagcuttgaug

SEQ ID NO: 102047 - DNA, 21 bp, Artificial Sequence
  Synthetic
cacguaggagaatgggtuggg

SEQ ID NO: 102048 - DNA, 20 bp, Artificial Sequence
  Synthetic
gaaccucuggcaggagcaaa

SEQ ID NO: 102049 - DNA, 19 bp, Artificial Sequence
  Synthetic
caagcatgcucagccagug

SEQ ID NO: 102050 - DNA, 27 bp, Artificial Sequence
  Synthetic
ggaattgtctugatttctctcccugaa

SEQ ID NO: 102051 - DNA, 24 bp, Artificial Sequence
  Synthetic
cacctttctcauacaggcttcucc

SEQ ID NO: 102052 - DNA, 25 bp, Artificial Sequence
  Synthetic
gaagatactgutgatcccaguggat

SEQ ID NO: 102053 - DNA, 20 bp, Artificial Sequence
  Synthetic
gaatggcacaggguacguct

SEQ ID NO: 102054 - DNA, 22 bp, Artificial Sequence
  Synthetic
ctggaauttgaggcuacccagt

SEQ ID NO: 102055 - DNA, 22 bp, Artificial Sequence
  Synthetic
ggaauaaaccacgucgcacaga

SEQ ID NO: 102056 - DNA, 23 bp, Artificial Sequence
  Synthetic
tccaccaauagtgagcuccaaga

SEQ ID NO: 102057 - DNA, 27 bp, Artificial Sequence
  Synthetic
gcataaagcctuttaggcatacacugt

SEQ ID NO: 102058 - DNA, 23 bp, Artificial Sequence
  Synthetic
agcctacttaccuctgacgtgut

SEQ ID NO: 102059 - DNA, 24 bp, Artificial Sequence
  Synthetic
cttttccaacucctcctcctgtuc

SEQ ID NO: 102060 - DNA, 23 bp, Artificial Sequence
  Synthetic
agacggagcautttacacctuga

SEQ ID NO: 102061 - DNA, 25 bp, Artificial Sequence
  Synthetic
agacaaaagcauagcagagtcctut

SEQ ID NO: 102062 - DNA, 24 bp, Artificial Sequence
  Synthetic
gctcattgccutttcacagaacut

SEQ ID NO: 102063 - DNA, 25 bp, Artificial Sequence
  Synthetic
aagucacttcuaaacagccagacag

SEQ ID NO: 102064 - DNA, 23 bp, Artificial Sequence
  Synthetic
gcagaugtgcuaagagaggagga

SEQ ID NO: 102065 - DNA, 25 bp, Artificial Sequence
  Synthetic
gctgtcaactuagactgtgctttut

SEQ ID NO: 102066 - DNA, 28 bp, Artificial Sequence
  Synthetic
agcgtgugatcaaaacauacaagaaaat

SEQ ID NO: 102067 - DNA, 20 bp, Artificial Sequence
  Synthetic
gaaaggguccgtcagcauga

SEQ ID NO: 102068 - DNA, 21 bp, Artificial Sequence
  Synthetic
aacccugttgccaugacagaa

SEQ ID NO: 102069 - DNA, 24 bp, Artificial Sequence
  Synthetic
cacttcctgccuggtatctctuac

SEQ ID NO: 102070 - DNA, 22 bp, Artificial Sequence
  Synthetic
caggaccuattgagctcugcat

SEQ ID NO: 102071 - DNA, 26 bp, Artificial Sequence
  Synthetic
tgtaaaagucccactccaauacacac

SEQ ID NO: 102072 - DNA, 22 bp, Artificial Sequence
  Synthetic
gggcutggtgttuagaagaaca

SEQ ID NO: 102073 - DNA, 28 bp, Artificial Sequence
  Synthetic
ccctgttgctugggataataatacucat

SEQ ID NO: 102074 - DNA, 27 bp, Artificial Sequence
  Synthetic
tgaaagatccauggaatctctccaaug

SEQ ID NO: 102075 - DNA, 24 bp, Artificial Sequence
  Synthetic
cccauatcctccgucagaacaaag

SEQ ID NO: 102076 - DNA, 27 bp, Artificial Sequence
  Synthetic
ctctgttactattucctccttgcacut

SEQ ID NO: 102077 - DNA, 25 bp, Artificial Sequence
  Synthetic
ctgagcaucccaaatgatattgucc

SEQ ID NO: 102078 - DNA, 21 bp, Artificial Sequence
  Synthetic
tctggtatauggacgcuggga

SEQ ID NO: 102079 - DNA, 28 bp, Artificial Sequence
  Synthetic
gttgacatuaacagcaagtttucaaagg

SEQ ID NO: 102080 - DNA, 21 bp, Artificial Sequence
  Synthetic
ggaatuccaggtacacuccct

SEQ ID NO: 102081 - DNA, 24 bp, Artificial Sequence
  Synthetic
gcatcaccaautccatccttguca

SEQ ID NO: 102082 - DNA, 22 bp, Artificial Sequence
  Synthetic
ccaacucagggcaggaagacua

SEQ ID NO: 102083 - DNA, 27 bp, Artificial Sequence
  Synthetic
gctgaacugaaaagaugaaaaagggat

SEQ ID NO: 102084 - DNA, 27 bp, Artificial Sequence
  Synthetic
actgtagtttctutgtgtcttggtugt

SEQ ID NO: 102085 - DNA, 21 bp, Artificial Sequence
  Synthetic
gttgtccuccaggctcaucat

SEQ ID NO: 102086 - DNA, 23 bp, Artificial Sequence
  Synthetic
cgtgggaagugatcaaatgctuc

SEQ ID NO: 102087 - DNA, 22 bp, Artificial Sequence
  Synthetic
tgcagccccaautccuaaaaca

SEQ ID NO: 102088 - DNA, 21 bp, Artificial Sequence
  Synthetic
tgcttaugacccgatccucct

SEQ ID NO: 102089 - DNA, 21 bp, Artificial Sequence
  Synthetic
gcttgccugccttguaccaat

SEQ ID NO: 102090 - DNA, 22 bp, Artificial Sequence
  Synthetic
cacagctguagtcttcctcuga

SEQ ID NO: 102091 - DNA, 20 bp, Artificial Sequence
  Synthetic
cagguccacaaaagguggct

SEQ ID NO: 102092 - DNA, 21 bp, Artificial Sequence
  Synthetic
gcucagaaagggaggaaucgg

SEQ ID NO: 102093 - DNA, 21 bp, Artificial Sequence
  Synthetic
cccuttagctuccaggaaggt

SEQ ID NO: 102094 - DNA, 23 bp, Artificial Sequence
  Synthetic
ccttccucacacttcctugaact

SEQ ID NO: 102095 - DNA, 23 bp, Artificial Sequence
  Synthetic
tgtttctgctcuctgcttcctut

SEQ ID NO: 102096 - DNA, 21 bp, Artificial Sequence
  Synthetic
cgactcgugctgtccctttut

SEQ ID NO: 102097 - DNA, 20 bp, Artificial Sequence
  Synthetic
ccuacuccccacaacccaga

SEQ ID NO: 102098 - DNA, 22 bp, Artificial Sequence
  Synthetic
tgcaaaagaugggaaaccugga

SEQ ID NO: 102099 - DNA, 26 bp, Artificial Sequence
  Synthetic
gcggatgccuttccattgattttaut

SEQ ID NO: 102100 - DNA, 23 bp, Artificial Sequence
  Synthetic
ggaaaccutgaccagugaccaat

SEQ ID NO: 102101 - DNA, 21 bp, Artificial Sequence
  Synthetic
tgtttgacaucctccccaucc

SEQ ID NO: 102102 - DNA, 23 bp, Artificial Sequence
  Synthetic
cagctgcatugggaggatgauat

SEQ ID NO: 102103 - DNA, 20 bp, Artificial Sequence
  Synthetic
gcuagacacagcuggcacag

SEQ ID NO: 102104 - DNA, 21 bp, Artificial Sequence
  Synthetic
actggugaagccaucccaaag

SEQ ID NO: 102105 - DNA, 24 bp, Artificial Sequence
  Synthetic
gaagacuacaacagtgagcuccaa

SEQ ID NO: 102106 - DNA, 20 bp, Artificial Sequence
  Synthetic
agcagccacutttcgaccuc

SEQ ID NO: 102107 - DNA, 26 bp, Artificial Sequence
  Synthetic
gtgagttgcacugggtttttgtaaua

SEQ ID NO: 102108 - DNA, 28 bp, Artificial Sequence
  Synthetic
tttcaggagttuactacctgcttaaugg

SEQ ID NO: 102109 - DNA, 25 bp, Artificial Sequence
  Synthetic
tgtctcagaugtaccagagttugga

SEQ ID NO: 102110 - DNA, 21 bp, Artificial Sequence
  Synthetic
ggctgacgugcttctgaagut

SEQ ID NO: 102111 - DNA, 26 bp, Artificial Sequence
  Synthetic
gggaaaatccauttagatgtacuggt

SEQ ID NO: 102112 - DNA, 25 bp, Artificial Sequence
  Synthetic
attgcacagutataatcccucagca

SEQ ID NO: 102113 - DNA, 28 bp, Artificial Sequence
  Synthetic
gtaccaagcagaaacuactacagaaugt

SEQ ID NO: 102114 - DNA, 23 bp, Artificial Sequence
  Synthetic
cttgctctugttcctgtuccaga

SEQ ID NO: 102115 - DNA, 24 bp, Artificial Sequence
  Synthetic
cctgatgtgtuatcccaggagtug

SEQ ID NO: 102116 - DNA, 28 bp, Artificial Sequence
  Synthetic
aagtagatuagcagattttctgugcact

SEQ ID NO: 102117 - DNA, 28 bp, Artificial Sequence
  Synthetic
cctctgactttugctcctgttcatatua

SEQ ID NO: 102118 - DNA, 23 bp, Artificial Sequence
  Synthetic
gatgatttcuccccttccauccc

SEQ ID NO: 102119 - DNA, 21 bp, Artificial Sequence
  Synthetic
gccagguctgguacacacaat

SEQ ID NO: 102120 - DNA, 23 bp, Artificial Sequence
  Synthetic
gggcagttcutttgtgtgttuca

SEQ ID NO: 102121 - DNA, 21 bp, Artificial Sequence
  Synthetic
ggtccttcaugtgctgctugt

SEQ ID NO: 102122 - DNA, 20 bp, Artificial Sequence
  Synthetic
ccctagggcugaacatgcut

SEQ ID NO: 102123 - DNA, 22 bp, Artificial Sequence
  Synthetic
ccttggcugaccaatgtcugag

SEQ ID NO: 102124 - DNA, 21 bp, Artificial Sequence
  Synthetic
cttggtgtcugcactcaaugg

SEQ ID NO: 102125 - DNA, 21 bp, Artificial Sequence
  Synthetic
cagccagcuaacaaccucact

SEQ ID NO: 102126 - DNA, 28 bp, Artificial Sequence
  Synthetic
aataaacttgcugatctttcctcucaca

SEQ ID NO: 102127 - DNA, 22 bp, Artificial Sequence
  Synthetic
ctgtgttgtuaccctgtcugct

SEQ ID NO: 102128 - DNA, 22 bp, Artificial Sequence
  Synthetic
tcttatgggcutccgtugcaaa

SEQ ID NO: 102129 - DNA, 22 bp, Artificial Sequence
  Synthetic
gctttcacgaugttccctccuc

SEQ ID NO: 102130 - DNA, 20 bp, Artificial Sequence
  Synthetic
caagtggccgugacagttuc

SEQ ID NO: 102131 - DNA, 23 bp, Artificial Sequence
  Synthetic
gatgctcuggcagtgtugaaaaa

SEQ ID NO: 102132 - DNA, 21 bp, Artificial Sequence
  Synthetic
ggaagcagucctcagccttuc

SEQ ID NO: 102133 - DNA, 27 bp, Artificial Sequence
  Synthetic
gaatcaataacuctctcttccctucca

SEQ ID NO: 102134 - DNA, 28 bp, Artificial Sequence
  Synthetic
tctctaagccuttaaaaacacactuggt

SEQ ID NO: 102135 - DNA, 28 bp, Artificial Sequence
  Synthetic
ccaatgaagaguttcaagcatttcugaa

SEQ ID NO: 102136 - DNA, 25 bp, Artificial Sequence
  Synthetic
agcctgcttauctttaaggcatugt

SEQ ID NO: 102137 - DNA, 23 bp, Artificial Sequence
  Synthetic
agagcaaacutgatgcagugact

SEQ ID NO: 102138 - DNA, 23 bp, Artificial Sequence
  Synthetic
cctctttcuggtcttggaaugct

SEQ ID NO: 102139 - DNA, 23 bp, Artificial Sequence
  Synthetic
ccatctgaaaaucgggagctcug

SEQ ID NO: 102140 - DNA, 28 bp, Artificial Sequence
  Synthetic
aatgtgcatacaaaguttgtccttctug

SEQ ID NO: 102141 - DNA, 28 bp, Artificial Sequence
  Synthetic
acttcagcucacaattgtaatgcauagt

SEQ ID NO: 102142 - DNA, 21 bp, Artificial Sequence
  Synthetic
ctctgcaggaaguccttugct

SEQ ID NO: 102143 - DNA, 27 bp, Artificial Sequence
  Synthetic
cctcaatgatgcucttcaaaatgcuaa

SEQ ID NO: 102144 - DNA, 20 bp, Artificial Sequence
  Synthetic
gagacccgugggtttgtuct

SEQ ID NO: 102145 - DNA, 24 bp, Artificial Sequence
  Synthetic
gaggattttggcauctggtgatut

SEQ ID NO: 102146 - DNA, 21 bp, Artificial Sequence
  Synthetic
acggcagcagautctaaugct

SEQ ID NO: 102147 - DNA, 21 bp, Artificial Sequence
  Synthetic
gcagaautccuccagagccat

SEQ ID NO: 102148 - DNA, 22 bp, Artificial Sequence
  Synthetic
catcctgacauccctcaucgaa

SEQ ID NO: 102149 - DNA, 20 bp, Artificial Sequence
  Synthetic
gggagaucacauggcacacc

SEQ ID NO: 102150 - DNA, 19 bp, Artificial Sequence
  Synthetic
cctcagcuggcggagaaug

SEQ ID NO: 102151 - DNA, 19 bp, Artificial Sequence
  Synthetic
ctgaggaccuccaccucct

SEQ ID NO: 102152 - DNA, 21 bp, Artificial Sequence
  Synthetic
ctccctgccuagctgatcuct

SEQ ID NO: 102153 - DNA, 23 bp, Artificial Sequence
  Synthetic
cctaaaggugccacacaaacuca

SEQ ID NO: 102154 - DNA, 27 bp, Artificial Sequence
  Synthetic
cccatcaaaatgucaagtgctttguaa

SEQ ID NO: 102155 - DNA, 21 bp, Artificial Sequence
  Synthetic
tggagtcucagccacctcuac

SEQ ID NO: 102156 - DNA, 23 bp, Artificial Sequence
  Synthetic
gttctucaacgtcauccaaccaa

SEQ ID NO: 102157 - DNA, 28 bp, Artificial Sequence
  Synthetic
cccatcctgatauttttcctggatttuc

SEQ ID NO: 102158 - DNA, 23 bp, Artificial Sequence
  Synthetic
agctggcttuctgtgagcaauat

SEQ ID NO: 102159 - DNA, 26 bp, Artificial Sequence
  Synthetic
ggacutgctttgatucagaacaagaa

SEQ ID NO: 102160 - DNA, 25 bp, Artificial Sequence
  Synthetic
catgacaatgcuagagacgtctuct

SEQ ID NO: 102161 - DNA, 26 bp, Artificial Sequence
  Synthetic
caccccagagutccataauagaacaa

SEQ ID NO: 102162 - DNA, 28 bp, Artificial Sequence
  Synthetic
acctgtttacaaauaagcagaguggaaa

SEQ ID NO: 102163 - DNA, 21 bp, Artificial Sequence
  Synthetic
aaggagcugatttcugcggat

SEQ ID NO: 102164 - DNA, 23 bp, Artificial Sequence
  Synthetic
gaagcauattcctuccgagcaag

SEQ ID NO: 102165 - DNA, 26 bp, Artificial Sequence
  Synthetic
cagaccatatuaccatcgctgaauga

SEQ ID NO: 102166 - DNA, 21 bp, Artificial Sequence
  Synthetic
acttccugccagggagtgaua

SEQ ID NO: 102167 - DNA, 27 bp, Artificial Sequence
  Synthetic
agagggutagcttatuagaagacacca

SEQ ID NO: 102168 - DNA, 21 bp, Artificial Sequence
  Synthetic
ctcagcgaggcugtgttcuaa

SEQ ID NO: 102169 - DNA, 28 bp, Artificial Sequence
  Synthetic
acatccaagaggaaaucagaaaaaucca

SEQ ID NO: 102170 - DNA, 21 bp, Artificial Sequence
  Synthetic
tcagcguaaagcagguacaca

SEQ ID NO: 102171 - DNA, 21 bp, Artificial Sequence
  Synthetic
gagagcccugcatgauaagca

SEQ ID NO: 102172 - DNA, 22 bp, Artificial Sequence
  Synthetic
gctggctugtgcactctuacat

SEQ ID NO: 102173 - DNA, 22 bp, Artificial Sequence
  Synthetic
caaagccutguccgagaaaacc

SEQ ID NO: 102174 - DNA, 24 bp, Artificial Sequence
  Synthetic
tcactgagguaggaatgaucgact

SEQ ID NO: 102175 - DNA, 27 bp, Artificial Sequence
  Synthetic
cctaatgaaugagagttctgagctuca

SEQ ID NO: 102176 - DNA, 28 bp, Artificial Sequence
  Synthetic
gaatgttttggtauttagccagttgugt

SEQ ID NO: 102177 - DNA, 29 bp, Artificial Sequence
  Synthetic
cggttacaagaacuagagaagaattuggt

SEQ ID NO: 102178 - DNA, 22 bp, Artificial Sequence
  Synthetic
tcgtgttctuggtaagcacugg

SEQ ID NO: 102179 - DNA, 23 bp, Artificial Sequence
  Synthetic
cgguggatgaacugaaccagaaa

SEQ ID NO: 102180 - DNA, 21 bp, Artificial Sequence
  Synthetic
gaacccucacctgcatgtuga

SEQ ID NO: 102181 - DNA, 24 bp, Artificial Sequence
  Synthetic
tggctttaucagaactgtcagucc

SEQ ID NO: 102182 - DNA, 22 bp, Artificial Sequence
  Synthetic
cagctttcuggcctccaauaga

SEQ ID NO: 102183 - DNA, 22 bp, Artificial Sequence
  Synthetic
tgcuttcactaucgccgaaaca

SEQ ID NO: 102184 - DNA, 25 bp, Artificial Sequence
  Synthetic
ccagtggcaagcuttatcaaaauct

SEQ ID NO: 102185 - DNA, 22 bp, Artificial Sequence
  Synthetic
gcaggaaaagagugaagtgcug

SEQ ID NO: 102186 - DNA, 22 bp, Artificial Sequence
  Synthetic
ggaacacugccatgagaaacug

SEQ ID NO: 102187 - DNA, 21 bp, Artificial Sequence
  Synthetic
tuggtctcaaugagcgacagg

SEQ ID NO: 102188 - DNA, 26 bp, Artificial Sequence
  Synthetic
ggcaatattucaggatgatgtcucca

SEQ ID NO: 102189 - DNA, 22 bp, Artificial Sequence
  Synthetic
gctcctuagaagctgugcaagt

SEQ ID NO: 102190 - DNA, 24 bp, Artificial Sequence
  Synthetic
cttacctgaagautgtccaccuga

SEQ ID NO: 102191 - DNA, 23 bp, Artificial Sequence
  Synthetic
tgctgaaaucagtgctugaccaa

SEQ ID NO: 102192 - DNA, 21 bp, Artificial Sequence
  Synthetic
cagtcttgggauccccagtuc

SEQ ID NO: 102193 - DNA, 25 bp, Artificial Sequence
  Synthetic
gcctttcatucagttattcaugcca

SEQ ID NO: 102194 - DNA, 21 bp, Artificial Sequence
  Synthetic
ccagcagcaggutctcatugt

SEQ ID NO: 102195 - DNA, 22 bp, Artificial Sequence
  Synthetic
ctgugggaaacagtcttugcag

SEQ ID NO: 102196 - DNA, 24 bp, Artificial Sequence
  Synthetic
gactggaccucttcctgatgaaut

SEQ ID NO: 102197 - DNA, 25 bp, Artificial Sequence
  Synthetic
cgaatggugcagagtatagactucc

SEQ ID NO: 102198 - DNA, 21 bp, Artificial Sequence
  Synthetic
ggccactutgtgactacucca

SEQ ID NO: 102199 - DNA, 28 bp, Artificial Sequence
  Synthetic
ctgaaaccctgaugaagttcttagaugt

SEQ ID NO: 102200 - DNA, 22 bp, Artificial Sequence
  Synthetic
tctgcaatucctgaagctuccc

SEQ ID NO: 102201 - DNA, 27 bp, Artificial Sequence
  Synthetic
agatgatgugagcaaacaagucaaaac

SEQ ID NO: 102202 - DNA, 20 bp, Artificial Sequence
  Synthetic
gtccaccaautccggucgaa

SEQ ID NO: 102203 - DNA, 29 bp, Artificial Sequence
  Synthetic
tgcttgtatctatucagaatgtgacauca

SEQ ID NO: 102204 - DNA, 23 bp, Artificial Sequence
  Synthetic
tgtttgggtcugtgtggaaauca

SEQ ID NO: 102205 - DNA, 24 bp, Artificial Sequence
  Synthetic
gcagcaaugaagtcagcauacaac

SEQ ID NO: 102206 - DNA, 22 bp, Artificial Sequence
  Synthetic
ctgtgcugcgaaaaccttctut

SEQ ID NO: 102207 - DNA, 25 bp, Artificial Sequence
  Synthetic
gtgaactugaagcccaattctugag

SEQ ID NO: 102208 - DNA, 26 bp, Artificial Sequence
  Synthetic
aggcaacauaagcttuacaacaagga

SEQ ID NO: 102209 - DNA, 28 bp, Artificial Sequence
  Synthetic
acctgacataaaagucaatgacctuacc

SEQ ID NO: 102210 - DNA, 23 bp, Artificial Sequence
  Synthetic
atcagagagagccutctggauga

SEQ ID NO: 102211 - DNA, 20 bp, Artificial Sequence
  Synthetic
gcagagcccucctccagaua

SEQ ID NO: 102212 - DNA, 21 bp, Artificial Sequence
  Synthetic
tcggtgggaacuttgctcauc

SEQ ID NO: 102213 - DNA, 29 bp, Artificial Sequence
  Synthetic
acaagttctataaaguccaggaagcaaut

SEQ ID NO: 102214 - DNA, 21 bp, Artificial Sequence
  Synthetic
gggagcgacucatctcaguct

SEQ ID NO: 102215 - DNA, 21 bp, Artificial Sequence
  Synthetic
cacctugaccccttggctuat

SEQ ID NO: 102216 - DNA, 22 bp, Artificial Sequence
  Synthetic
gtgtgctggugattgagcttut

SEQ ID NO: 102217 - DNA, 21 bp, Artificial Sequence
  Synthetic
tccttcauggcagtccagtug

SEQ ID NO: 102218 - DNA, 21 bp, Artificial Sequence
  Synthetic
ccaugagaaggttcugagcca

SEQ ID NO: 102219 - DNA, 28 bp, Artificial Sequence
  Synthetic
aggacctcautaaaaggaaaauccaagt

SEQ ID NO: 102220 - DNA, 20 bp, Artificial Sequence
  Synthetic
cacaucaacccctaccucgt

SEQ ID NO: 102221 - DNA, 27 bp, Artificial Sequence
  Synthetic
ccaaaatgcttgutctaagggaaauct

SEQ ID NO: 102222 - DNA, 21 bp, Artificial Sequence
  Synthetic
tggatctgaugcctggcttuc

SEQ ID NO: 102223 - DNA, 23 bp, Artificial Sequence
  Synthetic
ccugcagaggagaagcucaaaat

SEQ ID NO: 102224 - DNA, 21 bp, Artificial Sequence
  Synthetic
gccaccaugatctccctcuga

SEQ ID NO: 102225 - DNA, 27 bp, Artificial Sequence
  Synthetic
tcaacattaacuccaccgatatagcug

SEQ ID NO: 102226 - DNA, 23 bp, Artificial Sequence
  Synthetic
ccatcagctauatcggtggagut

SEQ ID NO: 102227 - DNA, 27 bp, Artificial Sequence
  Synthetic
ttactcccaugtactattacauaggca

SEQ ID NO: 102228 - DNA, 23 bp, Artificial Sequence
  Synthetic
tgcutaattactucaggcaccga

SEQ ID NO: 102229 - DNA, 22 bp, Artificial Sequence
  Synthetic
aataccacgacacgutcgtuct

SEQ ID NO: 102230 - DNA, 22 bp, Artificial Sequence
  Synthetic
gcuctccccugcaaaacagaat

SEQ ID NO: 102231 - DNA, 25 bp, Artificial Sequence
  Synthetic
ttgatctacttuatcgcctgcucac

SEQ ID NO: 102232 - DNA, 17 bp, Artificial Sequence
  Synthetic
cccaaggccgacugcug

SEQ ID NO: 102233 - DNA, 27 bp, Artificial Sequence
  Synthetic
aggttaaaaaggccacugaaatgatug

SEQ ID NO: 102234 - DNA, 25 bp, Artificial Sequence
  Synthetic
ccaggtaactuatcttgcagcugat

SEQ ID NO: 102235 - DNA, 26 bp, Artificial Sequence
  Synthetic
gtggcttttaugggagttaccctaut

SEQ ID NO: 102236 - DNA, 25 bp, Artificial Sequence
  Synthetic
tggcagaguaaccagattaguagca

SEQ ID NO: 102237 - DNA, 22 bp, Artificial Sequence
  Synthetic
cucaaacggacaucaccaacag

SEQ ID NO: 102238 - DNA, 26 bp, Artificial Sequence
  Synthetic
acatttcucccaacaatcacaguagg

SEQ ID NO: 102239 - DNA, 28 bp, Artificial Sequence
  Synthetic
tctctggtttcagugagttatacctuca

SEQ ID NO: 102240 - DNA, 25 bp, Artificial Sequence
  Synthetic
gtaacccaacaaagguggtgaaaut

SEQ ID NO: 102241 - DNA, 28 bp, Artificial Sequence
  Synthetic
caccttacgtauggtctctaaatccaut

SEQ ID NO: 102242 - DNA, 21 bp, Artificial Sequence
  Synthetic
aaggaagctuaaggcggtugt

SEQ ID NO: 102243 - DNA, 23 bp, Artificial Sequence
  Synthetic
ggaggcaucaacttgcaaucaat

SEQ ID NO: 102244 - DNA, 28 bp, Artificial Sequence
  Synthetic
gccatttcaucacccagttaauaagaaa

SEQ ID NO: 102245 - DNA, 25 bp, Artificial Sequence
  Synthetic
tgatgaaaagaaucaggcacucaga

SEQ ID NO: 102246 - DNA, 28 bp, Artificial Sequence
  Synthetic
agatgactaugatgctgattgugaagac

SEQ ID NO: 102247 - DNA, 27 bp, Artificial Sequence
  Synthetic
gctcctcagacaaaaguagacaatcuc

SEQ ID NO: 102248 - DNA, 29 bp, Artificial Sequence
  Synthetic
tttcttaacactcucctatccctguaact

SEQ ID NO: 102249 - DNA, 26 bp, Artificial Sequence
  Synthetic
agtctctgcuggacaatttgaaagua

SEQ ID NO: 102250 - DNA, 25 bp, Artificial Sequence
  Synthetic
tgtacacacacgutcatctcttuca

SEQ ID NO: 102251 - DNA, 28 bp, Artificial Sequence
  Synthetic
gcatttgcaautgacctgtguaaagaag

SEQ ID NO: 102252 - DNA, 23 bp, Artificial Sequence
  Synthetic
tcacacaagaggacugacccuat

SEQ ID NO: 102253 - DNA, 28 bp, Artificial Sequence
  Synthetic
aagaacagaaggagaaguacttagguct

SEQ ID NO: 102254 - DNA, 29 bp, Artificial Sequence
  Synthetic
aagggagagtucagaaggtaatatgguat

SEQ ID NO: 102255 - DNA, 25 bp, Artificial Sequence
  Synthetic
gccttgtctauaacagtcccctuag

SEQ ID NO: 102256 - DNA, 21 bp, Artificial Sequence
  Synthetic
gctttacctgucctccaccut

SEQ ID NO: 102257 - DNA, 28 bp, Artificial Sequence
  Synthetic
tttttaggtcaautggcatgatttugct

SEQ ID NO: 102258 - DNA, 23 bp, Artificial Sequence
  Synthetic
gatggugaaaggaatgcuccagt

SEQ ID NO: 102259 - DNA, 20 bp, Artificial Sequence
  Synthetic
gacaagacaggcuggacgua

SEQ ID NO: 102260 - DNA, 26 bp, Artificial Sequence
  Synthetic
ggagcacaucgggaaagatgaaaaua

SEQ ID NO: 102261 - DNA, 24 bp, Artificial Sequence
  Synthetic
gtggccgauctttactttuccaga

SEQ ID NO: 102262 - DNA, 27 bp, Artificial Sequence
  Synthetic
ttcctctagcaaauaatgacccugaac

SEQ ID NO: 102263 - DNA, 28 bp, Artificial Sequence
  Synthetic
tcagattctcugagttctcatctuggat

SEQ ID NO: 102264 - DNA, 24 bp, Artificial Sequence
  Synthetic
tgagaaaaacaugacggtgaucca

SEQ ID NO: 102265 - DNA, 28 bp, Artificial Sequence
  Synthetic
acaaggcaaauccagaagtgtcattaut

SEQ ID NO: 102266 - DNA, 28 bp, Artificial Sequence
  Synthetic
tgatccccttuaattgtgtctcattugt

SEQ ID NO: 102267 - DNA, 33 bp, Artificial Sequence
  Synthetic
acttaattgttaaatutccatgagtgaatucaa

SEQ ID NO: 102268 - DNA, 24 bp, Artificial Sequence
  Synthetic
ggcaggttttuatttaccgcctut

SEQ ID NO: 102269 - DNA, 28 bp, Artificial Sequence
  Synthetic
agacaaauaactagucacaacagacgac

SEQ ID NO: 102270 - DNA, 29 bp, Artificial Sequence
  Synthetic
tcacatcaagattugttctctgaagtuct

SEQ ID NO: 102271 - DNA, 24 bp, Artificial Sequence
  Synthetic
cacatcctgucctagaaagcugat

SEQ ID NO: 102272 - DNA, 23 bp, Artificial Sequence
  Synthetic
cccagctcutatttgtccctugt

SEQ ID NO: 102273 - DNA, 23 bp, Artificial Sequence
  Synthetic
tctgaaaggaguccatccaccua

SEQ ID NO: 102274 - DNA, 21 bp, Artificial Sequence
  Synthetic
gcgattctcutcctgccugaa

SEQ ID NO: 102275 - DNA, 19 bp, Artificial Sequence
  Synthetic
agggcactuggatcccgua

SEQ ID NO: 102276 - DNA, 25 bp, Artificial Sequence
  Synthetic
aagcaaagaacaguctcctugagat

SEQ ID NO: 102277 - DNA, 21 bp, Artificial Sequence
  Synthetic
caaccgguactggucaaggac

SEQ ID NO: 102278 - DNA, 22 bp, Artificial Sequence
  Synthetic
cctggaataguggaggtgctug

SEQ ID NO: 102279 - DNA, 28 bp, Artificial Sequence
  Synthetic
ttaaggccagtuaagagaacatgtuagg

SEQ ID NO: 102280 - DNA, 25 bp, Artificial Sequence
  Synthetic
aggattgttcauaccacaggtgtuc

SEQ ID NO: 102281 - DNA, 21 bp, Artificial Sequence
  Synthetic
gcccttgugcctcaucacaaa

SEQ ID NO: 102282 - DNA, 18 bp, Artificial Sequence
  Synthetic
gccgtgutctggguggag

SEQ ID NO: 102283 - DNA, 27 bp, Artificial Sequence
  Synthetic
cggtagccauaagcacaacattuaaag

SEQ ID NO: 102284 - DNA, 21 bp, Artificial Sequence
  Synthetic
gctgacaguggccttcaucac

SEQ ID NO: 102285 - DNA, 29 bp, Artificial Sequence
  Synthetic
tggaaatgacuagggaatggttcaaaaut

SEQ ID NO: 102286 - DNA, 21 bp, Artificial Sequence
  Synthetic
gggacacacugctgaugacag

SEQ ID NO: 102287 - DNA, 26 bp, Artificial Sequence
  Synthetic
cttaggacctccauctttaccaccua

SEQ ID NO: 102288 - DNA, 21 bp, Artificial Sequence
  Synthetic
tggguaacugagagcagaggt

SEQ ID NO: 102289 - DNA, 27 bp, Artificial Sequence
  Synthetic
cacaaaaguggaagaatcgttgaugaa

SEQ ID NO: 102290 - DNA, 21 bp, Artificial Sequence
  Synthetic
agcttggugaacggaaaggut

SEQ ID NO: 102291 - DNA, 29 bp, Artificial Sequence
  Synthetic
cctattctgatuggtatggctctacucat

SEQ ID NO: 102292 - DNA, 23 bp, Artificial Sequence
  Synthetic
cacaaguctcatttugggcacag

SEQ ID NO: 102293 - DNA, 25 bp, Artificial Sequence
  Synthetic
ctgaaguagcaaaaggaacccugaa

SEQ ID NO: 102294 - DNA, 23 bp, Artificial Sequence
  Synthetic
gtgtacttugagccgtgaaaucc

SEQ ID NO: 102295 - DNA, 28 bp, Artificial Sequence
  Synthetic
acgtgaacagaauttctactgaaugagt

SEQ ID NO: 102296 - DNA, 27 bp, Artificial Sequence
  Synthetic
cttggtagccacautcttgaagtttut

SEQ ID NO: 102297 - DNA, 28 bp, Artificial Sequence
  Synthetic
gcctttactucaccattcaattttcuct

SEQ ID NO: 102298 - DNA, 27 bp, Artificial Sequence
  Synthetic
gggacactaatgauattctctcccaut

SEQ ID NO: 102299 - DNA, 20 bp, Artificial Sequence
  Synthetic
tggctggugaaggtccctua

SEQ ID NO: 102300 - DNA, 22 bp, Artificial Sequence
  Synthetic
tgcaagcagggaauggaatuca

SEQ ID NO: 102301 - DNA, 20 bp, Artificial Sequence
  Synthetic
ccagcgacaccuggatgtuc

SEQ ID NO: 102302 - DNA, 23 bp, Artificial Sequence
  Synthetic
tgaacattucccacagtgucacc

SEQ ID NO: 102303 - DNA, 22 bp, Artificial Sequence
  Synthetic
ggtgttugagagggcttctcut

SEQ ID NO: 102304 - DNA, 27 bp, Artificial Sequence
  Synthetic
ccaaaugatttcaaaugacagcacagt

SEQ ID NO: 102305 - DNA, 27 bp, Artificial Sequence
  Synthetic
ccacatatcutcctcttguaacaggga

SEQ ID NO: 102306 - DNA, 21 bp, Artificial Sequence
  Synthetic
gattccctugcggagcttuac

SEQ ID NO: 102307 - DNA, 24 bp, Artificial Sequence
  Synthetic
gaccuctcatuacacacccaagac

SEQ ID NO: 102308 - DNA, 19 bp, Artificial Sequence
  Synthetic
gcccaggcuctgtacctuc

SEQ ID NO: 102309 - DNA, 19 bp, Artificial Sequence
  Synthetic
tgtccgcauggcctttcut

SEQ ID NO: 102310 - DNA, 27 bp, Artificial Sequence
  Synthetic
ttttggtgtguttgtctcagatugaac

SEQ ID NO: 102311 - DNA, 22 bp, Artificial Sequence
  Synthetic
tcctgaggugtgcgcauaaaaa

SEQ ID NO: 102312 - DNA, 21 bp, Artificial Sequence
  Synthetic
cttcagguggtggagagaugt

SEQ ID NO: 102313 - DNA, 29 bp, Artificial Sequence
  Synthetic
cagagactcacccguttataatagttcut

SEQ ID NO: 102314 - DNA, 21 bp, Artificial Sequence
  Synthetic
gttggcauggcaaccaagaua

SEQ ID NO: 102315 - DNA, 25 bp, Artificial Sequence
  Synthetic
gcagtttgtcucactacagctaugt

SEQ ID NO: 102316 - DNA, 26 bp, Artificial Sequence
  Synthetic
ttcatgaattgccutgtaacctaugg

SEQ ID NO: 102317 - DNA, 26 bp, Artificial Sequence
  Synthetic
attttaacactugggactggttcuct

SEQ ID NO: 102318 - DNA, 26 bp, Artificial Sequence
  Synthetic
cagtatcattgautcgcaacagugac

SEQ ID NO: 102319 - DNA, 28 bp, Artificial Sequence
  Synthetic
gaactttcacaaaauggatcaactcuca

SEQ ID NO: 102320 - DNA, 24 bp, Artificial Sequence
  Synthetic
gtagttucctttacctuggccaga

SEQ ID NO: 102321 - DNA, 25 bp, Artificial Sequence
  Synthetic
ttcacgattccutccagatttgugt

SEQ ID NO: 102322 - DNA, 29 bp, Artificial Sequence
  Synthetic
ccagatctacuaaagcagaauaccaacat

SEQ ID NO: 102323 - DNA, 26 bp, Artificial Sequence
  Synthetic
cttagaaaaugccagcagtgtgatug

SEQ ID NO: 102324 - DNA, 28 bp, Artificial Sequence
  Synthetic
ctcctgatctttuatggtagttctggut

SEQ ID NO: 102325 - DNA, 21 bp, Artificial Sequence
  Synthetic
agggtcagugctgtggactua

SEQ ID NO: 102326 - DNA, 28 bp, Artificial Sequence
  Synthetic
gctgatttcaggutctgatattctcuca

SEQ ID NO: 102327 - DNA, 21 bp, Artificial Sequence
  Synthetic
agtccaatugcaggcaacuct

SEQ ID NO: 102328 - DNA, 22 bp, Artificial Sequence
  Synthetic
ggagaccucagtactgcuccat

SEQ ID NO: 102329 - DNA, 26 bp, Artificial Sequence
  Synthetic
agagggtgatucagactcagtuagag

SEQ ID NO: 102330 - DNA, 28 bp, Artificial Sequence
  Synthetic
agaauaacatcacagucaagaaaccaca

SEQ ID NO: 102331 - DNA, 25 bp, Artificial Sequence
  Synthetic
aggagtugcgacagatgaucaaaat

SEQ ID NO: 102332 - DNA, 26 bp, Artificial Sequence
  Synthetic
gaaaaacaacaaccagguctguaaca

SEQ ID NO: 102333 - DNA, 26 bp, Artificial Sequence
  Synthetic
tgctagacucagtagtgaaucaacga

SEQ ID NO: 102334 - DNA, 22 bp, Artificial Sequence
  Synthetic
cagcccacacutcttuaagggt

SEQ ID NO: 102335 - DNA, 28 bp, Artificial Sequence
  Synthetic
gcctactgatgaguattctttcttccut

SEQ ID NO: 102336 - DNA, 29 bp, Artificial Sequence
  Synthetic
atttgaaaagaagucctagtggagtcauc

SEQ ID NO: 102337 - DNA, 21 bp, Artificial Sequence
  Synthetic
agggcctgcucaaaagtctuc

SEQ ID NO: 102338 - DNA, 22 bp, Artificial Sequence
  Synthetic
atctuggaggttcugcaaacga

SEQ ID NO: 102339 - DNA, 27 bp, Artificial Sequence
  Synthetic
tggaagcaaugactgagaaatuacagt

SEQ ID NO: 102340 - DNA, 28 bp, Artificial Sequence
  Synthetic
gctgaagtctutctttcatctgaugaca

SEQ ID NO: 102341 - DNA, 28 bp, Artificial Sequence
  Synthetic
ccaagctttuccagagaatggtgauaat

SEQ ID NO: 102342 - DNA, 24 bp, Artificial Sequence
  Synthetic
aaggauaaccugcccaaaagacaa

SEQ ID NO: 102343 - DNA, 28 bp, Artificial Sequence
  Synthetic
actgaaaaatgcccutttatcacctcua

SEQ ID NO: 102344 - DNA, 22 bp, Artificial Sequence
  Synthetic
aggccaaagacggguttcatua

SEQ ID NO: 102345 - DNA, 24 bp, Artificial Sequence
  Synthetic
gagtcagccaugattttctuccct

SEQ ID NO: 102346 - DNA, 20 bp, Artificial Sequence
  Synthetic
caucgcuacaaagcccagga

SEQ ID NO: 102347 - DNA, 21 bp, Artificial Sequence
  Synthetic
cgacugccaccatcgtauagt

SEQ ID NO: 102348 - DNA, 23 bp, Artificial Sequence
  Synthetic
tgtacaguacacgctagugaggt

SEQ ID NO: 102349 - DNA, 24 bp, Artificial Sequence
  Synthetic
cctgcccgucaatgtcatgaauat

SEQ ID NO: 102350 - DNA, 20 bp, Artificial Sequence
  Synthetic
ctttgucgccagcttgaucc

SEQ ID NO: 102351 - DNA, 26 bp, Artificial Sequence
  Synthetic
gaaaatcaaucagccaaactcagcut

SEQ ID NO: 102352 - DNA, 22 bp, Artificial Sequence
  Synthetic
cctgtgggcugttcttggtuaa

SEQ ID NO: 102353 - DNA, 21 bp, Artificial Sequence
  Synthetic
gctggctguccatgttctcug

SEQ ID NO: 102354 - DNA, 22 bp, Artificial Sequence
  Synthetic
cctgcagaguggtgatgtauga

SEQ ID NO: 102355 - DNA, 25 bp, Artificial Sequence
  Synthetic
tgtacattcauggtgatgttgcuct

SEQ ID NO: 102356 - DNA, 21 bp, Artificial Sequence
  Synthetic
ggacacgtccuctcctctcuc

SEQ ID NO: 102357 - DNA, 21 bp, Artificial Sequence
  Synthetic
agggtgtucaccttgcttucc

SEQ ID NO: 102358 - DNA, 18 bp, Artificial Sequence
  Synthetic
cacaaccucgcccagtuc

SEQ ID NO: 102359 - DNA, 18 bp, Artificial Sequence
  Synthetic
cggagcgcccutcacaut

SEQ ID NO: 102360 - DNA, 17 bp, Artificial Sequence
  Synthetic
gacccgccagcccuaut

SEQ ID NO: 102361 - DNA, 17 bp, Artificial Sequence
  Synthetic
gcggcugtgggtttugg

SEQ ID NO: 102362 - DNA, 28 bp, Artificial Sequence
  Synthetic
attcagtuacacgaacactaaucaaaga

SEQ ID NO: 102363 - DNA, 23 bp, Artificial Sequence
  Synthetic
aaccuaaucaaggaagcgggaaa

SEQ ID NO: 102364 - DNA, 27 bp, Artificial Sequence
  Synthetic
aagtagcutgagaaagtuggaaggaaa

SEQ ID NO: 102365 - DNA, 28 bp, Artificial Sequence
  Synthetic
tcagtttgctaaugggttgctcttauat

SEQ ID NO: 102366 - DNA, 25 bp, Artificial Sequence
  Synthetic
aggtccattttuctctggtttguca

SEQ ID NO: 102367 - DNA, 22 bp, Artificial Sequence
  Synthetic
ccaucacagctacaugaacgct

SEQ ID NO: 102368 - DNA, 20 bp, Artificial Sequence
  Synthetic
aacctatcccguccaccuga

SEQ ID NO: 102369 - DNA, 18 bp, Artificial Sequence
  Synthetic
ctacggcggauggacugt

SEQ ID NO: 102370 - DNA, 24 bp, Artificial Sequence
  Synthetic
tggttcatguaggcagggttacua

SEQ ID NO: 102371 - DNA, 20 bp, Artificial Sequence
  Synthetic
gttcagcguggcaugaacat

SEQ ID NO: 102372 - DNA, 24 bp, Artificial Sequence
  Synthetic
tgacccaccauattctggtacuga

SEQ ID NO: 102373 - DNA, 27 bp, Artificial Sequence
  Synthetic
ctcacttagtuttcttttgcttuggca

SEQ ID NO: 102374 - DNA, 20 bp, Artificial Sequence
  Synthetic
cagaaugagctctgcuccct

SEQ ID NO: 102375 - DNA, 18 bp, Artificial Sequence
  Synthetic
agccgagggugtggagua

SEQ ID NO: 102376 - DNA, 21 bp, Artificial Sequence
  Synthetic
gtgtcagcgcucagattucac

SEQ ID NO: 102377 - DNA, 20 bp, Artificial Sequence
  Synthetic
gaacccggutcuagaagcca

SEQ ID NO: 102378 - DNA, 22 bp, Artificial Sequence
  Synthetic
ggaatgaugcggagggtaacug

SEQ ID NO: 102379 - DNA, 22 bp, Artificial Sequence
  Synthetic
ctgtggcaagcugaaaguagga

SEQ ID NO: 102380 - DNA, 22 bp, Artificial Sequence
  Synthetic
cacaatccucttgggtcugaca

SEQ ID NO: 102381 - DNA, 21 bp, Artificial Sequence
  Synthetic
tgagtugggcaaguggaaaga

SEQ ID NO: 102382 - DNA, 23 bp, Artificial Sequence
  Synthetic
ctcatgtaagguccgttgaguga

SEQ ID NO: 102383 - DNA, 21 bp, Artificial Sequence
  Synthetic
gcctauacccagcagcctaug

SEQ ID NO: 102384 - DNA, 19 bp, Artificial Sequence
  Synthetic
gcttgucgcagcagaaguc

SEQ ID NO: 102385 - DNA, 22 bp, Artificial Sequence
  Synthetic
cactggaauaggcgtugaggat

SEQ ID NO: 102386 - DNA, 23 bp, Artificial Sequence
  Synthetic
cgggaguaggcatcagatuaacc

SEQ ID NO: 102387 - DNA, 22 bp, Artificial Sequence
  Synthetic
catttccauccgctccaaguct

SEQ ID NO: 102388 - DNA, 22 bp, Artificial Sequence
  Synthetic
ggcctgtguacatcatgtuccc

SEQ ID NO: 102389 - DNA, 21 bp, Artificial Sequence
  Synthetic
agcccatgaugaacagcagut

SEQ ID NO: 102390 - DNA, 21 bp, Artificial Sequence
  Synthetic
cagguccatugagggcaacat

SEQ ID NO: 102391 - DNA, 20 bp, Artificial Sequence
  Synthetic
cuaagcagucgaccccgaag

SEQ ID NO: 102392 - DNA, 23 bp, Artificial Sequence
  Synthetic
gtgtuccagaaccagttgtugag

SEQ ID NO: 102393 - DNA, 21 bp, Artificial Sequence
  Synthetic
cuccagcagaccauaagggat

SEQ ID NO: 102394 - DNA, 33 bp, Artificial Sequence
  Synthetic
aatttaagtacattttuctcattggcatatuct

SEQ ID NO: 102395 - DNA, 25 bp, Artificial Sequence
  Synthetic
acctcacagccagauacttggauaa

SEQ ID NO: 102396 - DNA, 28 bp, Artificial Sequence
  Synthetic
gtctttagcccaaagauactagcatugt

SEQ ID NO: 102397 - DNA, 27 bp, Artificial Sequence
  Synthetic
cgacttggauaaattttgctgaugagt

SEQ ID NO: 102398 - DNA, 20 bp, Artificial Sequence
  Synthetic
gatgggcuacggccauacag

SEQ ID NO: 102399 - DNA, 23 bp, Artificial Sequence
  Synthetic
ctcacatctccuctgcttcagug

SEQ ID NO: 102400 - DNA, 22 bp, Artificial Sequence
  Synthetic
tcttcatccugtggacccauca

SEQ ID NO: 102401 - DNA, 25 bp, Artificial Sequence
  Synthetic
ccacttttcttcutccctcttccuc

SEQ ID NO: 102402 - DNA, 21 bp, Artificial Sequence
  Synthetic
ggtaacgccacugttgaucac

SEQ ID NO: 102403 - DNA, 24 bp, Artificial Sequence
  Synthetic
ggccactggcugttgctatauaaa

SEQ ID NO: 102404 - DNA, 21 bp, Artificial Sequence
  Synthetic
gctcaagcugcttcttccgut

SEQ ID NO: 102405 - DNA, 22 bp, Artificial Sequence
  Synthetic
cattttgcuggtgggaugaact

SEQ ID NO: 102406 - DNA, 25 bp, Artificial Sequence
  Synthetic
gaacatccattuactgccaagaucc

SEQ ID NO: 102407 - DNA, 26 bp, Artificial Sequence
  Synthetic
ttccctttgcuatattcccacguaac

SEQ ID NO: 102408 - DNA, 28 bp, Artificial Sequence
  Synthetic
gtaaaacacauttagtgaagugaagcca

SEQ ID NO: 102409 - DNA, 22 bp, Artificial Sequence
  Synthetic
cctccccuccttgttgcattut

SEQ ID NO: 102410 - DNA, 22 bp, Artificial Sequence
  Synthetic
caaaggcaccautcccaucaag

SEQ ID NO: 102411 - DNA, 22 bp, Artificial Sequence
  Synthetic
cactgcaugtcttgcatucgat

SEQ ID NO: 102412 - DNA, 26 bp, Artificial Sequence
  Synthetic
gaaacacccauatuagaaggcagaga

SEQ ID NO: 102413 - DNA, 23 bp, Artificial Sequence
  Synthetic
tgttcuccctcgtatuaggccat

SEQ ID NO: 102414 - DNA, 28 bp, Artificial Sequence
  Synthetic
cctaacataaatggucagcagaagctua

SEQ ID NO: 102415 - DNA, 27 bp, Artificial Sequence
  Synthetic
tggatagactgauactgctttgttucc

SEQ ID NO: 102416 - DNA, 29 bp, Artificial Sequence
  Synthetic
cattttgcatatcautgtaggacttggut

SEQ ID NO: 102417 - DNA, 24 bp, Artificial Sequence
  Synthetic
catgcaaatgugtctctccaucac

SEQ ID NO: 102418 - DNA, 21 bp, Artificial Sequence
  Synthetic
ggccagacccaaacuttgaug

SEQ ID NO: 102419 - DNA, 24 bp, Artificial Sequence
  Synthetic
ctgttcauggcctgtatctucagt

SEQ ID NO: 102420 - DNA, 28 bp, Artificial Sequence
  Synthetic
ccatcctgttugaaattttgtccugaat

SEQ ID NO: 102421 - DNA, 25 bp, Artificial Sequence
  Synthetic
acacctuaacactggaaatuagcga

SEQ ID NO: 102422 - DNA, 22 bp, Artificial Sequence
  Synthetic
caatgttgguggcagacatgut

SEQ ID NO: 102423 - DNA, 22 bp, Artificial Sequence
  Synthetic
tgcaaccagugtttctctgucc

SEQ ID NO: 102424 - DNA, 20 bp, Artificial Sequence
  Synthetic
acagcauggcggtaaaggut

SEQ ID NO: 102425 - DNA, 29 bp, Artificial Sequence
  Synthetic
ccctgtgttgaugtggtatgtctatttua

SEQ ID NO: 102426 - DNA, 22 bp, Artificial Sequence
  Synthetic
gccagugagaagcagtauacca

SEQ ID NO: 102427 - DNA, 22 bp, Artificial Sequence
  Synthetic
ccaccactugccactcagtuag

SEQ ID NO: 102428 - DNA, 25 bp, Artificial Sequence
  Synthetic
ccaggaucaacaagcacaataauca

SEQ ID NO: 102429 - DNA, 27 bp, Artificial Sequence
  Synthetic
gtattcagaaaaacagcuaccctcuct

SEQ ID NO: 102430 - DNA, 29 bp, Artificial Sequence
  Synthetic
ctcatgagctcutatgtgttatgttugga

SEQ ID NO: 102431 - DNA, 23 bp, Artificial Sequence
  Synthetic
gcctctctucatctgagttguca

SEQ ID NO: 102432 - DNA, 21 bp, Artificial Sequence
  Synthetic
ccaaucacaacccucacccat

SEQ ID NO: 102433 - DNA, 20 bp, Artificial Sequence
  Synthetic
ctcggaaacgucaggtugga

SEQ ID NO: 102434 - DNA, 18 bp, Artificial Sequence
  Synthetic
gccutcccuccacccact

SEQ ID NO: 102435 - DNA, 24 bp, Artificial Sequence
  Synthetic
gctgaaaccacccuttctgatcut

SEQ ID NO: 102436 - DNA, 21 bp, Artificial Sequence
  Synthetic
cagctgagccagucctgtaut

SEQ ID NO: 102437 - DNA, 22 bp, Artificial Sequence
  Synthetic
ggcagctacuctcaaccaucag

SEQ ID NO: 102438 - DNA, 21 bp, Artificial Sequence
  Synthetic
ccttccugacctcaccacuct

SEQ ID NO: 102439 - DNA, 22 bp, Artificial Sequence
  Synthetic
cacccaaccacugacccataut

SEQ ID NO: 102440 - DNA, 24 bp, Artificial Sequence
  Synthetic
gacagaagtacugaatgagcccut

SEQ ID NO: 102441 - DNA, 23 bp, Artificial Sequence
  Synthetic
tgtcttttctucccaggctgaug

SEQ ID NO: 102442 - DNA, 25 bp, Artificial Sequence
  Synthetic
acctaggtauctcatgttgugaagt

SEQ ID NO: 102443 - DNA, 21 bp, Artificial Sequence
  Synthetic
gctaacccaucatggcccauc

SEQ ID NO: 102444 - DNA, 26 bp, Artificial Sequence
  Synthetic
aatgtgctttcacuaacatcctccut

SEQ ID NO: 102445 - DNA, 24 bp, Artificial Sequence
  Synthetic
gattcatgugaccgaggtttucac

SEQ ID NO: 102446 - DNA, 20 bp, Artificial Sequence
  Synthetic
ggcggaucacaacacuccat

SEQ ID NO: 102447 - DNA, 27 bp, Artificial Sequence
  Synthetic
tcatgatcguaacatgtttctgctuca

SEQ ID NO: 102448 - DNA, 28 bp, Artificial Sequence
  Synthetic
ttattgtggttugtgcagttttcauaat

SEQ ID NO: 102449 - DNA, 22 bp, Artificial Sequence
  Synthetic
aggctcattugtgctccttugt

SEQ ID NO: 102450 - DNA, 24 bp, Artificial Sequence
  Synthetic
cccauggaactttatuacgcacct

SEQ ID NO: 102451 - DNA, 27 bp, Artificial Sequence
  Synthetic
tctggcucagaaagaaaatugaacaac

SEQ ID NO: 102452 - DNA, 18 bp, Artificial Sequence
  Synthetic
tgtcauagccccgtgcug

SEQ ID NO: 102453 - DNA, 25 bp, Artificial Sequence
  Synthetic
caacttaccacuactgccacaauct

SEQ ID NO: 102454 - DNA, 24 bp, Artificial Sequence
  Synthetic
cctatccttttcucccctcaccut

SEQ ID NO: 102455 - DNA, 28 bp, Artificial Sequence
  Synthetic
tggatatgtcaaauatgtcgaccuagga

SEQ ID NO: 102456 - DNA, 24 bp, Artificial Sequence
  Synthetic
ccagtccugagaaaagcatuccag

SEQ ID NO: 102457 - DNA, 26 bp, Artificial Sequence
  Synthetic
acccagtcagauacagacattcucaa

SEQ ID NO: 102458 - DNA, 27 bp, Artificial Sequence
  Synthetic
tttatctgtgcugccttcttttguaga

SEQ ID NO: 102459 - DNA, 29 bp, Artificial Sequence
  Synthetic
aacctttcagugtatttatgtctgucaca

SEQ ID NO: 102460 - DNA, 28 bp, Artificial Sequence
  Synthetic
atcccattccaauatgtagcttctgtut

SEQ ID NO: 102461 - DNA, 27 bp, Artificial Sequence
  Synthetic
agcatgaagctaugataatgggaaguc

SEQ ID NO: 102462 - DNA, 24 bp, Artificial Sequence
  Synthetic
acttgggagutacgagatuccact

SEQ ID NO: 102463 - DNA, 22 bp, Artificial Sequence
  Synthetic
cccttgtgccucctgttatucc

SEQ ID NO: 102464 - DNA, 22 bp, Artificial Sequence
  Synthetic
gacaucacggctacaugaacac

SEQ ID NO: 102465 - DNA, 27 bp, Artificial Sequence
  Synthetic
tcaaaggtattugtgcagatcaaucca

SEQ ID NO: 102466 - DNA, 21 bp, Artificial Sequence
  Synthetic
ggattgctuggagggtggtut

SEQ ID NO: 102467 - DNA, 29 bp, Artificial Sequence
  Synthetic
gcccttggtttautgccttgagtattaut

SEQ ID NO: 102468 - DNA, 22 bp, Artificial Sequence
  Synthetic
acacagagaagguccacuggaa

SEQ ID NO: 102469 - DNA, 24 bp, Artificial Sequence
  Synthetic
cttgacutgtgttttcuccaccag

SEQ ID NO: 102470 - DNA, 26 bp, Artificial Sequence
  Synthetic
ggctctgacauacttgatctgttuct

SEQ ID NO: 102471 - DNA, 28 bp, Artificial Sequence
  Synthetic
atcagcttccuggatcatgaaaguaaat

SEQ ID NO: 102472 - DNA, 25 bp, Artificial Sequence
  Synthetic
tggaggagugcaaacuaaagaaaca

SEQ ID NO: 102473 - DNA, 26 bp, Artificial Sequence
  Synthetic
tcattccugctattccttuggagaag

SEQ ID NO: 102474 - DNA, 17 bp, Artificial Sequence
  Synthetic
ccctcccuccgcttcuc

SEQ ID NO: 102475 - DNA, 26 bp, Artificial Sequence
  Synthetic
agtauagcagacaacccaaugaacac

SEQ ID NO: 102476 - DNA, 23 bp, Artificial Sequence
  Synthetic
gttcagcauacaggcatcctuga

SEQ ID NO: 102477 - DNA, 28 bp, Artificial Sequence
  Synthetic
gctttctcaugaagtagttttctuccct

SEQ ID NO: 102478 - DNA, 21 bp, Artificial Sequence
  Synthetic
caucttgttgtguccccgagt

SEQ ID NO: 102479 - DNA, 28 bp, Artificial Sequence
  Synthetic
tctattacgatguggagccatttcttut

SEQ ID NO: 102480 - DNA, 21 bp, Artificial Sequence
  Synthetic
cgaagtcccautccaggtgug

SEQ ID NO: 102481 - DNA, 20 bp, Artificial Sequence
  Synthetic
tccagtuacccacccgauct

SEQ ID NO: 102482 - DNA, 22 bp, Artificial Sequence
  Synthetic
ggatgtggauttgccaagtcug

SEQ ID NO: 102483 - DNA, 24 bp, Artificial Sequence
  Synthetic
tctcaaccuacaacaatcgtugct

SEQ ID NO: 102484 - DNA, 25 bp, Artificial Sequence
  Synthetic
acccatuggacgaccgaaaaauaaa

SEQ ID NO: 102485 - DNA, 28 bp, Artificial Sequence
  Synthetic
acccctaaaggaauctgagagaauaaca

SEQ ID NO: 102486 - DNA, 29 bp, Artificial Sequence
  Synthetic
cccttgacatcautctgtgttagtacaua

SEQ ID NO: 102487 - DNA, 25 bp, Artificial Sequence
  Synthetic
gagaccctcuactgactgttttgut

SEQ ID NO: 102488 - DNA, 26 bp, Artificial Sequence
  Synthetic
acaagaugaaugaaaacggagagaca

SEQ ID NO: 102489 - DNA, 28 bp, Artificial Sequence
  Synthetic
atgtacattaagcuttgcaaaattguga

SEQ ID NO: 102490 - DNA, 23 bp, Artificial Sequence
  Synthetic
ccccatguggtgatgatttguga

SEQ ID NO: 102491 - DNA, 23 bp, Artificial Sequence
  Synthetic
tgctctcguttattttccuggca

SEQ ID NO: 102492 - DNA, 20 bp, Artificial Sequence
  Synthetic
cacctcaggcuccttggtut

SEQ ID NO: 102493 - DNA, 17 bp, Artificial Sequence
  Synthetic
augccccuacccgagga

SEQ ID NO: 102494 - DNA, 27 bp, Artificial Sequence
  Synthetic
gatgtcaggcugtacttaacacaaaug

SEQ ID NO: 102495 - DNA, 26 bp, Artificial Sequence
  Synthetic
tgctcttctugccctaaatgttctut

SEQ ID NO: 102496 - DNA, 20 bp, Artificial Sequence
  Synthetic
actcctgacuctgcccacua

SEQ ID NO: 102497 - DNA, 21 bp, Artificial Sequence
  Synthetic
cctttcaggcuactgctgcut

SEQ ID NO: 102498 - DNA, 27 bp, Artificial Sequence
  Synthetic
gacttctccautttcagtauaggccat

SEQ ID NO: 102499 - DNA, 28 bp, Artificial Sequence
  Synthetic
attaccacctgugaatagtagcatcauc

SEQ ID NO: 102500 - DNA, 27 bp, Artificial Sequence
  Synthetic
agtgactctttuacaggaggcaauaac

SEQ ID NO: 102501 - DNA, 22 bp, Artificial Sequence
  Synthetic
gtgatgaugcagtcugcacaaa

SEQ ID NO: 102502 - DNA, 19 bp, Artificial Sequence
  Synthetic
acttcacugctggcugcat

SEQ ID NO: 102503 - DNA, 24 bp, Artificial Sequence
  Synthetic
tcgtttccautcctaaagcuggac

SEQ ID NO: 102504 - DNA, 21 bp, Artificial Sequence
  Synthetic
cauctgctgagugaccacaca

SEQ ID NO: 102505 - DNA, 25 bp, Artificial Sequence
  Synthetic
gcaccacugaaaactaugagaaccc

SEQ ID NO: 102506 - DNA, 17 bp, Artificial Sequence
  Synthetic
ggcauccccagcacuga

SEQ ID NO: 102507 - DNA, 22 bp, Artificial Sequence
  Synthetic
tgcctgttucctacttcuccca

SEQ ID NO: 102508 - DNA, 26 bp, Artificial Sequence
  Synthetic
gaacaaaacaacccuacttaccucct

SEQ ID NO: 102509 - DNA, 19 bp, Artificial Sequence
  Synthetic
gugccgaggccugaaagaa

SEQ ID NO: 102510 - DNA, 20 bp, Artificial Sequence
  Synthetic
cccatcguggagtcguaact

SEQ ID NO: 102511 - DNA, 21 bp, Artificial Sequence
  Synthetic
ccccatgauggatgtgcctuc

SEQ ID NO: 102512 - DNA, 28 bp, Artificial Sequence
  Synthetic
atgactacaaaggagugtttacatcgut

SEQ ID NO: 102513 - DNA, 22 bp, Artificial Sequence
  Synthetic
cctggaaagcacuttcgtggua

SEQ ID NO: 102514 - DNA, 22 bp, Artificial Sequence
  Synthetic
cttctgagaaggguccgtgaug

SEQ ID NO: 102515 - DNA, 25 bp, Artificial Sequence
  Synthetic
tctctctcucacctcttcacaugat

SEQ ID NO: 102516 - DNA, 29 bp, Artificial Sequence
  Synthetic
ctgaagacaauaaaccacagtaagugagt

SEQ ID NO: 102517 - DNA, 21 bp, Artificial Sequence
  Synthetic
tcgtttgtcutcgcaggaugt

SEQ ID NO: 102518 - DNA, 24 bp, Artificial Sequence
  Synthetic
ggtcatctggaucaaaaggcaaug

SEQ ID NO: 102519 - DNA, 22 bp, Artificial Sequence
  Synthetic
cccacacucttgccttcuacag

SEQ ID NO: 102520 - DNA, 24 bp, Artificial Sequence
  Synthetic
caaaacagaaggucaagggtcuct

SEQ ID NO: 102521 - DNA, 19 bp, Artificial Sequence
  Synthetic
atccacaaguccgctgucc

SEQ ID NO: 102522 - DNA, 26 bp, Artificial Sequence
  Synthetic
gaggagtaccaggugtgaatttcaua

SEQ ID NO: 102523 - DNA, 30 bp, Artificial Sequence
  Synthetic
tctttgttatcucagtgtgtctaattuagc

SEQ ID NO: 102524 - DNA, 21 bp, Artificial Sequence
  Synthetic
acctgcugagagtggtcugat

SEQ ID NO: 102525 - DNA, 20 bp, Artificial Sequence
  Synthetic
ctgccctugagagtggcuac

SEQ ID NO: 102526 - DNA, 23 bp, Artificial Sequence
  Synthetic
ggtggcccuacttatgaaaugga

SEQ ID NO: 102527 - DNA, 24 bp, Artificial Sequence
  Synthetic
gcacatgaagaaaugtggttggut

SEQ ID NO: 102528 - DNA, 24 bp, Artificial Sequence
  Synthetic
ttagaagaggacugacaccugagt

SEQ ID NO: 102529 - DNA, 23 bp, Artificial Sequence
  Synthetic
gccaagatuagaacccacgttug

SEQ ID NO: 102530 - DNA, 22 bp, Artificial Sequence
  Synthetic
gautggagtcucaccacacaga

SEQ ID NO: 102531 - DNA, 20 bp, Artificial Sequence
  Synthetic
ctttggctucacggtggtug

SEQ ID NO: 102532 - DNA, 30 bp, Artificial Sequence
  Synthetic
ggtatacaaaaagaugtgatactcacuggt

SEQ ID NO: 102533 - DNA, 27 bp, Artificial Sequence
  Synthetic
tgacaagcagaucagcattaagaagut

SEQ ID NO: 102534 - DNA, 25 bp, Artificial Sequence
  Synthetic
cugtaaatctcatuggcaggaggat

SEQ ID NO: 102535 - DNA, 20 bp, Artificial Sequence
  Synthetic
atcgttuacaggcugcccaa

SEQ ID NO: 102536 - DNA, 24 bp, Artificial Sequence
  Synthetic
cactctccuggatcttgggttuac

SEQ ID NO: 102537 - DNA, 23 bp, Artificial Sequence
  Synthetic
ctggaagaaaagaccuggucgaa

SEQ ID NO: 102538 - DNA, 27 bp, Artificial Sequence
  Synthetic
cctgcacgtucttcttattaactucca

SEQ ID NO: 102539 - DNA, 22 bp, Artificial Sequence
  Synthetic
ggccaaugggctttggtttuac

SEQ ID NO: 102540 - DNA, 27 bp, Artificial Sequence
  Synthetic
ggctacgacuctttaaaattugcacat

SEQ ID NO: 102541 - DNA, 20 bp, Artificial Sequence
  Synthetic
cucggtgccuaaacaagcag

SEQ ID NO: 102542 - DNA, 23 bp, Artificial Sequence
  Synthetic
tgctagcataugtccgtatguga

SEQ ID NO: 102543 - DNA, 23 bp, Artificial Sequence
  Synthetic
caagttcautggctcuggaacag

SEQ ID NO: 102544 - DNA, 20 bp, Artificial Sequence
  Synthetic
ggctcuttccactugcccaa

SEQ ID NO: 102545 - DNA, 22 bp, Artificial Sequence
  Synthetic
ctgccagguaacagaagacugt

SEQ ID NO: 102546 - DNA, 25 bp, Artificial Sequence
  Synthetic
tcttcctccucttcttcatcgauct

SEQ ID NO: 102547 - DNA, 28 bp, Artificial Sequence
  Synthetic
cacaatagcagtguagtcacagaaacua

SEQ ID NO: 102548 - DNA, 26 bp, Artificial Sequence
  Synthetic
gttcatctaacacutcagtggtcuca

SEQ ID NO: 102549 - DNA, 33 bp, Artificial Sequence
  Synthetic
gaaaagatagtgtucataactgtaaatactugc

SEQ ID NO: 102550 - DNA, 24 bp, Artificial Sequence
  Synthetic
ccggctauactttcaaaacucagg

SEQ ID NO: 102551 - DNA, 28 bp, Artificial Sequence
  Synthetic
accacattgaccuatggtgttaattcut

SEQ ID NO: 102552 - DNA, 21 bp, Artificial Sequence
  Synthetic
cacactctuccagtggctuct

SEQ ID NO: 102553 - DNA, 22 bp, Artificial Sequence
  Synthetic
agtgtgtaautccgtcatuggg

SEQ ID NO: 102554 - DNA, 22 bp, Artificial Sequence
  Synthetic
gatccttgtuctgggctgauct

SEQ ID NO: 102555 - DNA, 21 bp, Artificial Sequence
  Synthetic
cgaggacccucagatguccat

SEQ ID NO: 102556 - DNA, 21 bp, Artificial Sequence
  Synthetic
ccgutcacactugcagaacag

SEQ ID NO: 102557 - DNA, 20 bp, Artificial Sequence
  Synthetic
ccgtgatcucgtcccuacca

SEQ ID NO: 102558 - DNA, 22 bp, Artificial Sequence
  Synthetic
gcagattccagucaacttgcut

SEQ ID NO: 102559 - DNA, 26 bp, Artificial Sequence
  Synthetic
tctccagagaaaccgutatctgauct

SEQ ID NO: 102560 - DNA, 23 bp, Artificial Sequence
  Synthetic
agccacauggaaaagcugaaaac

SEQ ID NO: 102561 - DNA, 28 bp, Artificial Sequence
  Synthetic
agacaatcattaccuctttctcagctuc

SEQ ID NO: 102562 - DNA, 20 bp, Artificial Sequence
  Synthetic
ccuggcaaccaatcuagggt

SEQ ID NO: 102563 - DNA, 23 bp, Artificial Sequence
  Synthetic
catacagaccugctccctttucc

SEQ ID NO: 102564 - DNA, 20 bp, Artificial Sequence
  Synthetic
caccaggacugtctgcgaua

SEQ ID NO: 102565 - DNA, 28 bp, Artificial Sequence
  Synthetic
gttctcatggtuatcctaatgacacugt

SEQ ID NO: 102566 - DNA, 25 bp, Artificial Sequence
  Synthetic
gatctggagaaacucatcaggtuca

SEQ ID NO: 102567 - DNA, 22 bp, Artificial Sequence
  Synthetic
agtggugacattccttaugcgt

SEQ ID NO: 102568 - DNA, 24 bp, Artificial Sequence
  Synthetic
cccgactcaacutaaatcctggut

SEQ ID NO: 102569 - DNA, 26 bp, Artificial Sequence
  Synthetic
gaaaacgtgaugtgaagaattcucct

SEQ ID NO: 102570 - DNA, 20 bp, Artificial Sequence
  Synthetic
ggacctgcuccagctccuat

SEQ ID NO: 102571 - DNA, 20 bp, Artificial Sequence
  Synthetic
ccacaccugcctttcccauc

SEQ ID NO: 102572 - DNA, 25 bp, Artificial Sequence
  Synthetic
caauatgccatguaggaaagacgac

SEQ ID NO: 102573 - DNA, 26 bp, Artificial Sequence
  Synthetic
gagttgctgaccuagttctgattuga

SEQ ID NO: 102574 - DNA, 23 bp, Artificial Sequence
  Synthetic
ggtgtggaugtatctggcucaag

SEQ ID NO: 102575 - DNA, 26 bp, Artificial Sequence
  Synthetic
tgctagtctuggaagaaggaacuaga

SEQ ID NO: 102576 - DNA, 25 bp, Artificial Sequence
  Synthetic
gcttgcctucgtaacacatttuaga

SEQ ID NO: 102577 - DNA, 22 bp, Artificial Sequence
  Synthetic
gtgtttttctucacagccggut

SEQ ID NO: 102578 - DNA, 23 bp, Artificial Sequence
  Synthetic
gctcattccagcauctgcttcut

SEQ ID NO: 102579 - DNA, 21 bp, Artificial Sequence
  Synthetic
ccaccccauttgcctcuacag

SEQ ID NO: 102580 - DNA, 29 bp, Artificial Sequence
  Synthetic
atactcttucagaactgtaagcuaaaacg

SEQ ID NO: 102581 - DNA, 22 bp, Artificial Sequence
  Synthetic
ctcgccaccaautcucacaaag

SEQ ID NO: 102582 - DNA, 21 bp, Artificial Sequence
  Synthetic
tccgagauggctggctattug

SEQ ID NO: 102583 - DNA, 22 bp, Artificial Sequence
  Synthetic
ggtgggaaaguctgtgtcucat

SEQ ID NO: 102584 - DNA, 21 bp, Artificial Sequence
  Synthetic
gacgcaugacagtctucaacc

SEQ ID NO: 102585 - DNA, 22 bp, Artificial Sequence
  Synthetic
gtacaggcagugcagtcttuga

SEQ ID NO: 102586 - DNA, 28 bp, Artificial Sequence
  Synthetic
gccataacttcuggtttcttttcactut

SEQ ID NO: 102587 - DNA, 31 bp, Artificial Sequence
  Synthetic
ttctctcaatacutaaaaggtcagaauaggt

SEQ ID NO: 102588 - DNA, 32 bp, Artificial Sequence
  Synthetic
accatatagaagaaacaautttatatggugca

SEQ ID NO: 102589 - DNA, 22 bp, Artificial Sequence
  Synthetic
ccaggaagagcutggcuaacaa

SEQ ID NO: 102590 - DNA, 23 bp, Artificial Sequence
  Synthetic
gaaatgcgtuacctttcgctuca

SEQ ID NO: 102591 - DNA, 26 bp, Artificial Sequence
  Synthetic
agatuaacagaaggaagugagaggct

SEQ ID NO: 102592 - DNA, 31 bp, Artificial Sequence
  Synthetic
ctgatactattcuctaaatttctgccuaggt

SEQ ID NO: 102593 - DNA, 23 bp, Artificial Sequence
  Synthetic
cagatgaaggugtgguacagact

SEQ ID NO: 102594 - DNA, 29 bp, Artificial Sequence
  Synthetic
gctaggttgaugggaatatgagcaaaaut

SEQ ID NO: 102595 - DNA, 22 bp, Artificial Sequence
  Synthetic
caaccagaugacagccctttuc

SEQ ID NO: 102596 - DNA, 23 bp, Artificial Sequence
  Synthetic
tgaggtcugagtcagcttucact

SEQ ID NO: 102597 - DNA, 20 bp, Artificial Sequence
  Synthetic
ggcttcgucatcgtgtccuc

SEQ ID NO: 102598 - DNA, 26 bp, Artificial Sequence
  Synthetic
acagattaccaaagcuttacctgugt

SEQ ID NO: 102599 - DNA, 27 bp, Artificial Sequence
  Synthetic
cgcttacctcaaauactgaaaggtcut

SEQ ID NO: 102600 - DNA, 24 bp, Artificial Sequence
  Synthetic
ctcaagagaaccaucatggcucat

SEQ ID NO: 102601 - DNA, 20 bp, Artificial Sequence
  Synthetic
gauacccaggacgaguggac

SEQ ID NO: 102602 - DNA, 22 bp, Artificial Sequence
  Synthetic
ggcuauggaggaagccaaagaa

SEQ ID NO: 102603 - DNA, 23 bp, Artificial Sequence
  Synthetic
tcaccagcuagccacagtaguaa

SEQ ID NO: 102604 - DNA, 27 bp, Artificial Sequence
  Synthetic
gtaaccagtgaugaaggatccaugaat

SEQ ID NO: 102605 - DNA, 21 bp, Artificial Sequence
  Synthetic
gggtctguaacagccaatcug

SEQ ID NO: 102606 - DNA, 28 bp, Artificial Sequence
  Synthetic
tgtattatgatgucgagccattccttut

SEQ ID NO: 102607 - DNA, 23 bp, Artificial Sequence
  Synthetic
ccctgtucaaagaattgggcuct

SEQ ID NO: 102608 - DNA, 26 bp, Artificial Sequence
  Synthetic
tccagcaaaugaaattuaccgaagga

SEQ ID NO: 102609 - DNA, 28 bp, Artificial Sequence
  Synthetic
accttctaaacacaaaucagcacauagt

SEQ ID NO: 102610 - DNA, 20 bp, Artificial Sequence
  Synthetic
cgutcagcacucaccaaagg

SEQ ID NO: 102611 - DNA, 17 bp, Artificial Sequence
  Synthetic
tcagcaccguggugcag

SEQ ID NO: 102612 - DNA, 22 bp, Artificial Sequence
  Synthetic
ccagutcacaaaaguccagcac

SEQ ID NO: 102613 - DNA, 24 bp, Artificial Sequence
  Synthetic
gagactgtcccugagtggtauaga

SEQ ID NO: 102614 - DNA, 18 bp, Artificial Sequence
  Synthetic
ccggatcuccacgtcgua

SEQ ID NO: 102615 - DNA, 21 bp, Artificial Sequence
  Synthetic
gccucgcugacagaagagaag

SEQ ID NO: 102616 - DNA, 22 bp, Artificial Sequence
  Synthetic
accaauacgggagaagucagga

SEQ ID NO: 102617 - DNA, 21 bp, Artificial Sequence
  Synthetic
ctgagaccaaguctgcugcaa

SEQ ID NO: 102618 - DNA, 20 bp, Artificial Sequence
  Synthetic
tcaccgtgutcagcgagtuc

SEQ ID NO: 102619 - DNA, 21 bp, Artificial Sequence
  Synthetic
tgatgtacgcgugcatctcuc

SEQ ID NO: 102620 - DNA, 24 bp, Artificial Sequence
  Synthetic
catgctcacugctttcttctugag

SEQ ID NO: 102621 - DNA, 20 bp, Artificial Sequence
  Synthetic
ccgtggtgucagagcagaug

SEQ ID NO: 102622 - DNA, 22 bp, Artificial Sequence
  Synthetic
catcugggaaggacucaagcag

SEQ ID NO: 102623 - DNA, 27 bp, Artificial Sequence
  Synthetic
caatgagcccuttggttttcttgtuaa

SEQ ID NO: 102624 - DNA, 21 bp, Artificial Sequence
  Synthetic
gggaggatugcagcagactug

SEQ ID NO: 102625 - DNA, 24 bp, Artificial Sequence
  Synthetic
ctgaccutgtgttttuacgggaag

SEQ ID NO: 102626 - DNA, 19 bp, Artificial Sequence
  Synthetic
caugcaugggacaggcaga

SEQ ID NO: 102627 - DNA, 21 bp, Artificial Sequence
  Synthetic
cctaaccctaugctcgcctut

SEQ ID NO: 102628 - DNA, 20 bp, Artificial Sequence
  Synthetic
tgtcacccucactguagcga

SEQ ID NO: 102629 - DNA, 22 bp, Artificial Sequence
  Synthetic
ggaaaccugacctucccaagag

SEQ ID NO: 102630 - DNA, 19 bp, Artificial Sequence
  Synthetic
accugcacaggactgctug

SEQ ID NO: 102631 - DNA, 17 bp, Artificial Sequence
  Synthetic
cccgacggcaccaucut

SEQ ID NO: 102632 - DNA, 22 bp, Artificial Sequence
  Synthetic
catgccatugactttgcctgut

SEQ ID NO: 102633 - DNA, 23 bp, Artificial Sequence
  Synthetic
ccttgaactcugccgaggttauc

SEQ ID NO: 102634 - DNA, 33 bp, Artificial Sequence
  Synthetic
taattagtgttaucccgaataatacatguacag

SEQ ID NO: 102635 - DNA, 27 bp, Artificial Sequence
  Synthetic
tggactactcugagcaatatcgaauca

SEQ ID NO: 102636 - DNA, 21 bp, Artificial Sequence
  Synthetic
tcaacccccucactgagtcut

SEQ ID NO: 102637 - DNA, 21 bp, Artificial Sequence
  Synthetic
agagacgtcutcagctccuca

SEQ ID NO: 102638 - DNA, 28 bp, Artificial Sequence
  Synthetic
acctacatttcugcctctacactuaaag

SEQ ID NO: 102639 - DNA, 27 bp, Artificial Sequence
  Synthetic
ttggacgatagugctttgaaaagtcua

SEQ ID NO: 102640 - DNA, 25 bp, Artificial Sequence
  Synthetic
gcactctttgaugggctttctcaua

SEQ ID NO: 102641 - DNA, 22 bp, Artificial Sequence
  Synthetic
cttttgccaaagaagugggcut

SEQ ID NO: 102642 - DNA, 21 bp, Artificial Sequence
  Synthetic
caaggtgggcutcaagguagg

SEQ ID NO: 102643 - DNA, 21 bp, Artificial Sequence
  Synthetic
tcaggacaccagguagccaua

SEQ ID NO: 102644 - DNA, 23 bp, Artificial Sequence
  Synthetic
tgatttcctgtugcccctcttuc

SEQ ID NO: 102645 - DNA, 27 bp, Artificial Sequence
  Synthetic
guctccttgaagtucaacaagaaaacc

SEQ ID NO: 102646 - DNA, 24 bp, Artificial Sequence
  Synthetic
gtcgcagaucacgaggtgaaatua

SEQ ID NO: 102647 - DNA, 24 bp, Artificial Sequence
  Synthetic
gtggaggttutagcttttgtgugg

SEQ ID NO: 102648 - DNA, 28 bp, Artificial Sequence
  Synthetic
actgaattatctuccacggcaaaatcua

SEQ ID NO: 102649 - DNA, 27 bp, Artificial Sequence
  Synthetic
catcctgtgcuttttaaggaaagtugt

SEQ ID NO: 102650 - DNA, 22 bp, Artificial Sequence
  Synthetic
gtaaggccaucaatgagcccut

SEQ ID NO: 102651 - DNA, 24 bp, Artificial Sequence
  Synthetic
agccaatcagcaucatcatcauca

SEQ ID NO: 102652 - DNA, 21 bp, Artificial Sequence
  Synthetic
gcaatugctcactucaagcga

SEQ ID NO: 102653 - DNA, 25 bp, Artificial Sequence
  Synthetic
gttggagcttugaccttttgctuac

SEQ ID NO: 102654 - DNA, 28 bp, Artificial Sequence
  Synthetic
gatttctccccacautctccatattgut

SEQ ID NO: 102655 - DNA, 26 bp, Artificial Sequence
  Synthetic
agtccttcctcaugatagtcttccug

SEQ ID NO: 102656 - DNA, 29 bp, Artificial Sequence
  Synthetic
ccatctatccgcuctaaatatccttctuc

SEQ ID NO: 102657 - DNA, 26 bp, Artificial Sequence
  Synthetic
tttagaucaaaaggtccctucagcaa

SEQ ID NO: 102658 - DNA, 26 bp, Artificial Sequence
  Synthetic
agagactattcaugcccttacacuga

SEQ ID NO: 102659 - DNA, 23 bp, Artificial Sequence
  Synthetic
gctgaattugcgacctgtagaug

SEQ ID NO: 102660 - DNA, 24 bp, Artificial Sequence
  Synthetic
cttctcatgtgutggctacaggua

SEQ ID NO: 102661 - DNA, 21 bp, Artificial Sequence
  Synthetic
gcactggcuggaagaactcug

SEQ ID NO: 102662 - DNA, 23 bp, Artificial Sequence
  Synthetic
ccagcgcaaacautctggatcua

SEQ ID NO: 102663 - DNA, 28 bp, Artificial Sequence
  Synthetic
gggtctcatcuccacattcatttttaug

SEQ ID NO: 102664 - DNA, 24 bp, Artificial Sequence
  Synthetic
atgctaattuggtgccatttuggt

SEQ ID NO: 102665 - DNA, 26 bp, Artificial Sequence
  Synthetic
tcagtaacgacauccttgttuccaat

SEQ ID NO: 102666 - DNA, 30 bp, Artificial Sequence
  Synthetic
ttactgctuaacccacaatgtaattaauct

SEQ ID NO: 102667 - DNA, 28 bp, Artificial Sequence
  Synthetic
gccaggaaatcaugactgagaaagauat

SEQ ID NO: 102668 - DNA, 21 bp, Artificial Sequence
  Synthetic
acctaccccagacucctcuct

SEQ ID NO: 102669 - DNA, 23 bp, Artificial Sequence
  Synthetic
caagggattuggctttagcctuc

SEQ ID NO: 102670 - DNA, 21 bp, Artificial Sequence
  Synthetic
ggctctggcucctctcaagua

SEQ ID NO: 102671 - DNA, 28 bp, Artificial Sequence
  Synthetic
gactataacuttctgactgugaaggagt

SEQ ID NO: 102672 - DNA, 29 bp, Artificial Sequence
  Synthetic
tcaaacaagaaagugcagatgtaaatgug

SEQ ID NO: 102673 - DNA, 24 bp, Artificial Sequence
  Synthetic
cttgctacuacaatgtgggaucct

SEQ ID NO: 102674 - DNA, 23 bp, Artificial Sequence
  Synthetic
catgttatactcucggcctccuc

SEQ ID NO: 102675 - DNA, 26 bp, Artificial Sequence
  Synthetic
gccttttugccaagaatgttuaggaa

SEQ ID NO: 102676 - DNA, 27 bp, Artificial Sequence
  Synthetic
ctaaagttcaguagcaaacatgctuca

SEQ ID NO: 102677 - DNA, 27 bp, Artificial Sequence
  Synthetic
accattttcaauctgttgtttctugcc

SEQ ID NO: 102678 - DNA, 28 bp, Artificial Sequence
  Synthetic
agtgcttgttctuggatatcacgaaaua

SEQ ID NO: 102679 - DNA, 24 bp, Artificial Sequence
  Synthetic
gggacagtuaacatgtgagctcut

SEQ ID NO: 102680 - DNA, 21 bp, Artificial Sequence
  Synthetic
gtcactgucgccaatttgcut

SEQ ID NO: 102681 - DNA, 29 bp, Artificial Sequence
  Synthetic
gagaaaagagacuggatttggattuagga

SEQ ID NO: 102682 - DNA, 28 bp, Artificial Sequence
  Synthetic
aaagaattttuggccttttacagtuggt

SEQ ID NO: 102683 - DNA, 23 bp, Artificial Sequence
  Synthetic
accttttggcautctggaaagug

SEQ ID NO: 102684 - DNA, 20 bp, Artificial Sequence
  Synthetic
actctgcucgagguccaaga

SEQ ID NO: 102685 - DNA, 27 bp, Artificial Sequence
  Synthetic
tgatggtttgtugtgcctttgtattut

SEQ ID NO: 102686 - DNA, 28 bp, Artificial Sequence
  Synthetic
agcacagaaacaccuagtattgatugag

SEQ ID NO: 102687 - DNA, 22 bp, Artificial Sequence
  Synthetic
tctctgactgutcttggtgcug

SEQ ID NO: 102688 - DNA, 24 bp, Artificial Sequence
  Synthetic
cagctctauaaaccccgaagcaua

SEQ ID NO: 102689 - DNA, 21 bp, Artificial Sequence
  Synthetic
gccacggcagacucctuaaag

SEQ ID NO: 102690 - DNA, 25 bp, Artificial Sequence
  Synthetic
atttcatauggaatgctgugaccca

SEQ ID NO: 102691 - DNA, 24 bp, Artificial Sequence
  Synthetic
aacctgtataccuctgagctguca

SEQ ID NO: 102692 - DNA, 22 bp, Artificial Sequence
  Synthetic
ccuggttcattuccacccagaa

SEQ ID NO: 102693 - DNA, 23 bp, Artificial Sequence
  Synthetic
gtcctgcaacugtgttcatctug

SEQ ID NO: 102694 - DNA, 20 bp, Artificial Sequence
  Synthetic
cctugactagacugcagcga

SEQ ID NO: 102695 - DNA, 21 bp, Artificial Sequence
  Synthetic
tgttacuagggcctgctucct

SEQ ID NO: 102696 - DNA, 28 bp, Artificial Sequence
  Synthetic
tccatctttaacacucaactccaatugt

SEQ ID NO: 102697 - DNA, 23 bp, Artificial Sequence
  Synthetic
agtggatttuggaggccaucaaa

SEQ ID NO: 102698 - DNA, 26 bp, Artificial Sequence
  Synthetic
cagtaatgcauccacacatagcaauc

SEQ ID NO: 102699 - DNA, 28 bp, Artificial Sequence
  Synthetic
gggatgaggccugaatactaattcaaut

SEQ ID NO: 102700 - DNA, 24 bp, Artificial Sequence
  Synthetic
acgctgtttcugctttttcactut

SEQ ID NO: 102701 - DNA, 28 bp, Artificial Sequence
  Synthetic
catcaggataagggauaacgactctaug

SEQ ID NO: 102702 - DNA, 26 bp, Artificial Sequence
  Synthetic
acttagagacacuttgccattgaucc

SEQ ID NO: 102703 - DNA, 25 bp, Artificial Sequence
  Synthetic
gtgattgccuactgttagctcuagt

SEQ ID NO: 102704 - DNA, 24 bp, Artificial Sequence
  Synthetic
tccagtaatggauggtgctaguga

SEQ ID NO: 102705 - DNA, 28 bp, Artificial Sequence
  Synthetic
agactgccttutacctccaaatuaaaca

SEQ ID NO: 102706 - DNA, 23 bp, Artificial Sequence
  Synthetic
gttgagccgauaaagagguccat

SEQ ID NO: 102707 - DNA, 27 bp, Artificial Sequence
  Synthetic
ctcaacttugaaaagcattgaacgtut

SEQ ID NO: 102708 - DNA, 25 bp, Artificial Sequence
  Synthetic
gtcactggugaaagaaccaaaaugt

SEQ ID NO: 102709 - DNA, 28 bp, Artificial Sequence
  Synthetic
gaggagtaccagguttggatttcataut

SEQ ID NO: 102710 - DNA, 19 bp, Artificial Sequence
  Synthetic
tggaagacugtggccggua

SEQ ID NO: 102711 - DNA, 26 bp, Artificial Sequence
  Synthetic
cattcaagutatacaccugccagact

SEQ ID NO: 102712 - DNA, 25 bp, Artificial Sequence
  Synthetic
gaaggaggaacaagaaaucctguca

SEQ ID NO: 102713 - DNA, 25 bp, Artificial Sequence
  Synthetic
cttcactgctcuctttagacagcuc

SEQ ID NO: 102714 - DNA, 28 bp, Artificial Sequence
  Synthetic
ccatagcactucccttccaaatacuaaa

SEQ ID NO: 102715 - DNA, 26 bp, Artificial Sequence
  Synthetic
cccttggcagucatcttagtcatuac

SEQ ID NO: 102716 - DNA, 23 bp, Artificial Sequence
  Synthetic
ggaaggaggccutttctgugaat

SEQ ID NO: 102717 - DNA, 26 bp, Artificial Sequence
  Synthetic
cagtaattggaaaaucacaccagcut

SEQ ID NO: 102718 - DNA, 21 bp, Artificial Sequence
  Synthetic
ccacagaccacccucctttuc

SEQ ID NO: 102719 - DNA, 18 bp, Artificial Sequence
  Synthetic
ggagcugcttcuggaggt

SEQ ID NO: 102720 - DNA, 17 bp, Artificial Sequence
  Synthetic
cgcuccgacguacggaa

SEQ ID NO: 102721 - DNA, 23 bp, Artificial Sequence
  Synthetic
gggtgtaacucatcatguccaaa

SEQ ID NO: 102722 - DNA, 26 bp, Artificial Sequence
  Synthetic
gtccagtaacuggtttctgagaauca

SEQ ID NO: 102723 - DNA, 28 bp, Artificial Sequence
  Synthetic
ctttagaatgggaguatcacagtgucat

SEQ ID NO: 102724 - DNA, 26 bp, Artificial Sequence
  Synthetic
cagacacatccutctgaccttucaaa

SEQ ID NO: 102725 - DNA, 20 bp, Artificial Sequence
  Synthetic
cctgggcgaauagcactucc

SEQ ID NO: 102726 - DNA, 24 bp, Artificial Sequence
  Synthetic
ccagtggtucttcttctggaucac

SEQ ID NO: 102727 - DNA, 24 bp, Artificial Sequence
  Synthetic
tgccaagtttcuctctcctgttut

SEQ ID NO: 102728 - DNA, 20 bp, Artificial Sequence
  Synthetic
agacagaggccaggaugcua

SEQ ID NO: 102729 - DNA, 17 bp, Artificial Sequence
  Synthetic
ggtgcuccccgagtucc

SEQ ID NO: 102730 - DNA, 21 bp, Artificial Sequence
  Synthetic
gctgcuggagctgtcuaaaga

SEQ ID NO: 102731 - DNA, 22 bp, Artificial Sequence
  Synthetic
ctgtggttucgtcaatctuggg

SEQ ID NO: 102732 - DNA, 24 bp, Artificial Sequence
  Synthetic
aattttccatggutccgaggctua

SEQ ID NO: 102733 - DNA, 27 bp, Artificial Sequence
  Synthetic
tggcttggaucgtaaaactgtttuaga

SEQ ID NO: 102734 - DNA, 26 bp, Artificial Sequence
  Synthetic
gctgtcuaaagagagcagugaagaag

SEQ ID NO: 102735 - DNA, 20 bp, Artificial Sequence
  Synthetic
gcaactgacugtggttucgt

SEQ ID NO: 102736 - DNA, 22 bp, Artificial Sequence
  Synthetic
cttgtugcataagcuggaccac

SEQ ID NO: 102737 - DNA, 28 bp, Artificial Sequence
  Synthetic
gcaatgtttcauccatcgttcaatuact

SEQ ID NO: 102738 - DNA, 26 bp, Artificial Sequence
  Synthetic
cagtctggaauactctgtccattugt

SEQ ID NO: 102739 - DNA, 27 bp, Artificial Sequence
  Synthetic
actctgtataaagugggtttgcaagut

SEQ ID NO: 102740 - DNA, 22 bp, Artificial Sequence
  Synthetic
tcagtttgauctggagctuggg

SEQ ID NO: 102741 - DNA, 23 bp, Artificial Sequence
  Synthetic
cccctctcacutgcttacttuca

SEQ ID NO: 102742 - DNA, 21 bp, Artificial Sequence
  Synthetic
agaggcuggtaagacacuggt

SEQ ID NO: 102743 - DNA, 23 bp, Artificial Sequence
  Synthetic
gcagagtucgtctgtttcugaag

SEQ ID NO: 102744 - DNA, 28 bp, Artificial Sequence
  Synthetic
tgaagaagtcattugtcaaccatgguaa

SEQ ID NO: 102745 - DNA, 25 bp, Artificial Sequence
  Synthetic
cagagacugtcttcttauccaaccc

SEQ ID NO: 102746 - DNA, 20 bp, Artificial Sequence
  Synthetic
ctgggcgcutttcatcagut

SEQ ID NO: 102747 - DNA, 28 bp, Artificial Sequence
  Synthetic
gatactuctctatgttctucagggagga

SEQ ID NO: 102748 - DNA, 21 bp, Artificial Sequence
  Synthetic
catgcggucagtactucccat

SEQ ID NO: 102749 - DNA, 24 bp, Artificial Sequence
  Synthetic
tgacttaggaaaagugcctggtut

SEQ ID NO: 102750 - DNA, 27 bp, Artificial Sequence
  Synthetic
ttaacaaaggaaaccagucatgtcuga

SEQ ID NO: 102751 - DNA, 28 bp, Artificial Sequence
  Synthetic
cttcatttctttaugctctgtccctcut

SEQ ID NO: 102752 - DNA, 20 bp, Artificial Sequence
  Synthetic
ggactugaggagccgaaugg

SEQ ID NO: 102753 - DNA, 20 bp, Artificial Sequence
  Synthetic
gtactgcgguccgtcttuca

SEQ ID NO: 102754 - DNA, 21 bp, Artificial Sequence
  Synthetic
ggttggaaugtgacucagcgt

SEQ ID NO: 102755 - DNA, 19 bp, Artificial Sequence
  Synthetic
cggucccuggacaaaagga

SEQ ID NO: 102756 - DNA, 26 bp, Artificial Sequence
  Synthetic
auggtgcuaaaagccaagaaaaagag

SEQ ID NO: 102757 - DNA, 21 bp, Artificial Sequence
  Synthetic
cagactccaugtggctgucat

SEQ ID NO: 102758 - DNA, 21 bp, Artificial Sequence
  Synthetic
ctaagcuctgggaaugccaca

SEQ ID NO: 102759 - DNA, 22 bp, Artificial Sequence
  Synthetic
ctccaagaugacgctctuccaa

SEQ ID NO: 102760 - DNA, 23 bp, Artificial Sequence
  Synthetic
cgctgtgaauaatgggaggtuac

SEQ ID NO: 102761 - DNA, 24 bp, Artificial Sequence
  Synthetic
gcacgaacatuactccttcgctua

SEQ ID NO: 102762 - DNA, 20 bp, Artificial Sequence
  Synthetic
gctggctcugtcctctcugt

SEQ ID NO: 102763 - DNA, 17 bp, Artificial Sequence
  Synthetic
gcggagacgguctcugg

SEQ ID NO: 102764 - DNA, 24 bp, Artificial Sequence
  Synthetic
catggaaaucgactctgagacugt

SEQ ID NO: 102765 - DNA, 17 bp, Artificial Sequence
  Synthetic
tggcaaucgucgagcgt

SEQ ID NO: 102766 - DNA, 25 bp, Artificial Sequence
  Synthetic
tgcccatggutatgctttcuaagac

SEQ ID NO: 102767 - DNA, 22 bp, Artificial Sequence
  Synthetic
ccacttagauagaccgcgctut

SEQ ID NO: 102768 - DNA, 21 bp, Artificial Sequence
  Synthetic
cagcugctcctauagcaacct

SEQ ID NO: 102769 - DNA, 18 bp, Artificial Sequence
  Synthetic
gaggccucuccaccacac

SEQ ID NO: 102770 - DNA, 20 bp, Artificial Sequence
  Synthetic
aggaccaugatgccgaugac

SEQ ID NO: 102771 - DNA, 22 bp, Artificial Sequence
  Synthetic
gccacaguccattaagaccuct

SEQ ID NO: 102772 - DNA, 21 bp, Artificial Sequence
  Synthetic
gcagcgucaagtctccucaag

SEQ ID NO: 102773 - DNA, 20 bp, Artificial Sequence
  Synthetic
ctctgacccautcgctcgua

SEQ ID NO: 102774 - DNA, 22 bp, Artificial Sequence
  Synthetic
cctctttugcaacggaacaugg

SEQ ID NO: 102775 - DNA, 19 bp, Artificial Sequence
  Synthetic
tcugggagcgcccauagat

SEQ ID NO: 102776 - DNA, 20 bp, Artificial Sequence
  Synthetic
gcaacgccaacautggctua

SEQ ID NO: 102777 - DNA, 28 bp, Artificial Sequence
  Synthetic
gctgtaaggcaaugaatgatcaauaagt

SEQ ID NO: 102778 - DNA, 23 bp, Artificial Sequence
  Synthetic
aaacaaguguggccaaaaggaac

SEQ ID NO: 102779 - DNA, 23 bp, Artificial Sequence
  Synthetic
ggctggttttuccttctgaaguc

SEQ ID NO: 102780 - DNA, 21 bp, Artificial Sequence
  Synthetic
ccgtctctccuacctggcaua

SEQ ID NO: 102781 - DNA, 22 bp, Artificial Sequence
  Synthetic
tcttgtcgaucatgtggaggug

SEQ ID NO: 102782 - DNA, 21 bp, Artificial Sequence
  Synthetic
accaaaguccacagatugcca

SEQ ID NO: 102783 - DNA, 22 bp, Artificial Sequence
  Synthetic
ggcactttgauctgggctgaut

SEQ ID NO: 102784 - DNA, 21 bp, Artificial Sequence
  Synthetic
ttaatgugcagcctggucact

SEQ ID NO: 102785 - DNA, 23 bp, Artificial Sequence
  Synthetic
gttcttttggucctgcttctgug

SEQ ID NO: 102786 - DNA, 26 bp, Artificial Sequence
  Synthetic
gccaaacugcagcagttaactaauac

SEQ ID NO: 102787 - DNA, 23 bp, Artificial Sequence
  Synthetic
ggagtguggagactgagaaagut

SEQ ID NO: 102788 - DNA, 21 bp, Artificial Sequence
  Synthetic
acatgacatugccaccacuct

SEQ ID NO: 102789 - DNA, 27 bp, Artificial Sequence
  Synthetic
actgttagggaaccucagtcttuaact

SEQ ID NO: 102790 - DNA, 20 bp, Artificial Sequence
  Synthetic
ctgccacccaucagucacaa

SEQ ID NO: 102791 - DNA, 22 bp, Artificial Sequence
  Synthetic
ccattcauggcgttgagagugt

SEQ ID NO: 102792 - DNA, 20 bp, Artificial Sequence
  Synthetic
gcttggcuaggctgaaggug

SEQ ID NO: 102793 - DNA, 19 bp, Artificial Sequence
  Synthetic
cccgctgucacagtguagt

SEQ ID NO: 102794 - DNA, 24 bp, Artificial Sequence
  Synthetic
gguaacaguggaagaacagaagga

SEQ ID NO: 102795 - DNA, 24 bp, Artificial Sequence
  Synthetic
ttctggttttucacctggtgaugt

SEQ ID NO: 102796 - DNA, 20 bp, Artificial Sequence
  Synthetic
tcttcguggtcgtccucaga

SEQ ID NO: 102797 - DNA, 24 bp, Artificial Sequence
  Synthetic
agcctggtgutcaagagtctttut

SEQ ID NO: 102798 - DNA, 18 bp, Artificial Sequence
  Synthetic
ggctgcugctgctggtua

SEQ ID NO: 102799 - DNA, 18 bp, Artificial Sequence
  Synthetic
gtccuccagcagccucac

SEQ ID NO: 102800 - DNA, 22 bp, Artificial Sequence
  Synthetic
ccctgctcuggaaaacagcuac

SEQ ID NO: 102801 - DNA, 21 bp, Artificial Sequence
  Synthetic
tcgatacugcccaggtcacua

SEQ ID NO: 102802 - DNA, 21 bp, Artificial Sequence
  Synthetic
tguacccgaatcugacgagga

SEQ ID NO: 102803 - DNA, 23 bp, Artificial Sequence
  Synthetic
ctctccugggtcaaagacugaac

SEQ ID NO: 102804 - DNA, 25 bp, Artificial Sequence
  Synthetic
accattaaguaacacagggcttgut

SEQ ID NO: 102805 - DNA, 26 bp, Artificial Sequence
  Synthetic
gtgagagaugccaatatttgaugcag

SEQ ID NO: 102806 - DNA, 21 bp, Artificial Sequence
  Synthetic
tgtgccccugtaaguccaaac

SEQ ID NO: 102807 - DNA, 27 bp, Artificial Sequence
  Synthetic
gcttttagcaccauctggatcttttuc

SEQ ID NO: 102808 - DNA, 28 bp, Artificial Sequence
  Synthetic
cttttccctacucttctgcatatuagca

SEQ ID NO: 102809 - DNA, 18 bp, Artificial Sequence
  Synthetic
cugcagagacugcccaga

SEQ ID NO: 102810 - DNA, 26 bp, Artificial Sequence
  Synthetic
tgtcaactctgugaacatgaacauga

SEQ ID NO: 102811 - DNA, 21 bp, Artificial Sequence
  Synthetic
ccatcugcatctgcauagggt

SEQ ID NO: 102812 - DNA, 18 bp, Artificial Sequence
  Synthetic
cagcgucgtggtcgucat

SEQ ID NO: 102813 - DNA, 24 bp, Artificial Sequence
  Synthetic
aauagtccugagaccgaaaccaag

SEQ ID NO: 102814 - DNA, 27 bp, Artificial Sequence
  Synthetic
agatgatcucatcaaaccugaggaaga

SEQ ID NO: 102815 - DNA, 25 bp, Artificial Sequence
  Synthetic
tctttttccguggagatttctggut

SEQ ID NO: 102816 - DNA, 20 bp, Artificial Sequence
  Synthetic
cgtcattcugggcagtcuct

SEQ ID NO: 102817 - DNA, 21 bp, Artificial Sequence
  Synthetic
gcagacagcagcaauagucct

SEQ ID NO: 102818 - DNA, 25 bp, Artificial Sequence
  Synthetic
ggcuatatgaaucaaacgccccaat

SEQ ID NO: 102819 - DNA, 22 bp, Artificial Sequence
  Synthetic
gagagacugtttggacaugcct

SEQ ID NO: 102820 - DNA, 23 bp, Artificial Sequence
  Synthetic
cagcaagtcguagacagtggaut

SEQ ID NO: 102821 - DNA, 21 bp, Artificial Sequence
  Synthetic
ctctgtgucagactgcuggag

SEQ ID NO: 102822 - DNA, 23 bp, Artificial Sequence
  Synthetic
actcagtguccaaatccaggtut

SEQ ID NO: 102823 - DNA, 23 bp, Artificial Sequence
  Synthetic
gtctaacatccutctccggctug

SEQ ID NO: 102824 - DNA, 27 bp, Artificial Sequence
  Synthetic
ttgcaggtuaaaagaatggcaaatuca

SEQ ID NO: 102825 - DNA, 28 bp, Artificial Sequence
  Synthetic
agtggttgtatguaaaaactgccaagua

SEQ ID NO: 102826 - DNA, 22 bp, Artificial Sequence
  Synthetic
cctgagatgcugttcctgaugt

SEQ ID NO: 102827 - DNA, 23 bp, Artificial Sequence
  Synthetic
agccagggugatgacattaccua

SEQ ID NO: 102828 - DNA, 20 bp, Artificial Sequence
  Synthetic
gaatcgggcaccacucacut

SEQ ID NO: 102829 - DNA, 24 bp, Artificial Sequence
  Synthetic
tcatgtctcuctccttccucacag

SEQ ID NO: 102830 - DNA, 25 bp, Artificial Sequence
  Synthetic
aatgacttcgaggucttgaatgugt

SEQ ID NO: 102831 - DNA, 19 bp, Artificial Sequence
  Synthetic
gccagagguccagguggaa

SEQ ID NO: 102832 - DNA, 20 bp, Artificial Sequence
  Synthetic
cttgttggccugtgggtuac

SEQ ID NO: 102833 - DNA, 20 bp, Artificial Sequence
  Synthetic
gatctgtgaugcagcccuct

SEQ ID NO: 102834 - DNA, 17 bp, Artificial Sequence
  Synthetic
cuctgccagucgcccaa

SEQ ID NO: 102835 - DNA, 24 bp, Artificial Sequence
  Synthetic
acaatctaugccctctgctttucc

SEQ ID NO: 102836 - DNA, 20 bp, Artificial Sequence
  Synthetic
gagtccaucaactgcugcct

SEQ ID NO: 102837 - DNA, 18 bp, Artificial Sequence
  Synthetic
gcaguagccgcccttcug

SEQ ID NO: 102838 - DNA, 20 bp, Artificial Sequence
  Synthetic
tccaaacacuacgccugcat

SEQ ID NO: 102839 - DNA, 23 bp, Artificial Sequence
  Synthetic
ctgggaagagutagtguccaagg

SEQ ID NO: 102840 - DNA, 28 bp, Artificial Sequence
  Synthetic
agcagaaagaagaaagguaaactggaut

SEQ ID NO: 102841 - DNA, 24 bp, Artificial Sequence
  Synthetic
gtgcctcugcaaacttttcctuag

SEQ ID NO: 102842 - DNA, 21 bp, Artificial Sequence
  Synthetic
cagccaagcauccaccuagaa

SEQ ID NO: 102843 - DNA, 21 bp, Artificial Sequence
  Synthetic
agtatgcaugggagccacauc

SEQ ID NO: 102844 - DNA, 22 bp, Artificial Sequence
  Synthetic
gcagtagcgagucacgtagtug

SEQ ID NO: 102845 - DNA, 20 bp, Artificial Sequence
  Synthetic
cctggaagcutggcugagag

SEQ ID NO: 102846 - DNA, 20 bp, Artificial Sequence
  Synthetic
gcatugagccgaagctccuc

SEQ ID NO: 102847 - DNA, 22 bp, Artificial Sequence
  Synthetic
gggcttctguccatctctttuc

SEQ ID NO: 102848 - DNA, 24 bp, Artificial Sequence
  Synthetic
ctgtggcatcugcacaaagtttua

SEQ ID NO: 102849 - DNA, 27 bp, Artificial Sequence
  Synthetic
gctcaaagtaaugaagaggtggtucaa

SEQ ID NO: 102850 - DNA, 28 bp, Artificial Sequence
  Synthetic
gctgtatggtautttaacagtaccugct

SEQ ID NO: 102851 - DNA, 27 bp, Artificial Sequence
  Synthetic
gcagctaucaaagcaatatucaagcat

SEQ ID NO: 102852 - DNA, 33 bp, Artificial Sequence
  Synthetic
tccatcgtagatauaaacttagaattggattut

SEQ ID NO: 102853 - DNA, 23 bp, Artificial Sequence
  Synthetic
tcauccggaattugggagaacac

SEQ ID NO: 102854 - DNA, 26 bp, Artificial Sequence
  Synthetic
gcttttcttcaucaatgtgttcuccc

SEQ ID NO: 102855 - DNA, 26 bp, Artificial Sequence
  Synthetic
ttgtgttgcuaccacatttttgtgut

SEQ ID NO: 102856 - DNA, 17 bp, Artificial Sequence
  Synthetic
agcggcaaugaccccut

SEQ ID NO: 102857 - DNA, 19 bp, Artificial Sequence
  Synthetic
caggagcgcutaccgaugt

SEQ ID NO: 102858 - DNA, 24 bp, Artificial Sequence
  Synthetic
gaagagacgaugaatgaggtccut

SEQ ID NO: 102859 - DNA, 24 bp, Artificial Sequence
  Synthetic
gcatcttuggcttgatttauggct

SEQ ID NO: 102860 - DNA, 21 bp, Artificial Sequence
  Synthetic
ctctggttugccactggtgua

SEQ ID NO: 102861 - DNA, 28 bp, Artificial Sequence
  Synthetic
gccttctgaacautccaaaagtttugac

SEQ ID NO: 102862 - DNA, 27 bp, Artificial Sequence
  Synthetic
gggaaagaagaagucatgatgttccut

SEQ ID NO: 102863 - DNA, 25 bp, Artificial Sequence
  Synthetic
cctagaagcuagagttggccatuac

SEQ ID NO: 102864 - DNA, 28 bp, Artificial Sequence
  Synthetic
gaattgttcataccutagtcgtccacut

SEQ ID NO: 102865 - DNA, 26 bp, Artificial Sequence
  Synthetic
gatcatttagtcaucttcagccgcua

SEQ ID NO: 102866 - DNA, 21 bp, Artificial Sequence
  Synthetic
gggcagauccagtgttctgug

SEQ ID NO: 102867 - DNA, 28 bp, Artificial Sequence
  Synthetic
agcatctattttcutgactttccccaut

SEQ ID NO: 102868 - DNA, 27 bp, Artificial Sequence
  Synthetic
ccttcagucaacaaagccaattatuga

SEQ ID NO: 102869 - DNA, 27 bp, Artificial Sequence
  Synthetic
cctgctuaccccaaaacaaataaucac

SEQ ID NO: 102870 - DNA, 27 bp, Artificial Sequence
  Synthetic
aagtatagtccuaccactgggtugaat

SEQ ID NO: 102871 - DNA, 27 bp, Artificial Sequence
  Synthetic
catactgtgaatcugggttcttcctut

SEQ ID NO: 102872 - DNA, 20 bp, Artificial Sequence
  Synthetic
aggagagcugcttcgtgaug

SEQ ID NO: 102873 - DNA, 23 bp, Artificial Sequence
  Synthetic
ctggttggcautcacactcctua

SEQ ID NO: 102874 - DNA, 27 bp, Artificial Sequence
  Synthetic
tcctttaggaaauggatcagacaaugg

SEQ ID NO: 102875 - DNA, 28 bp, Artificial Sequence
  Synthetic
aaaaagagaacgaaagauacatcugcct

SEQ ID NO: 102876 - DNA, 24 bp, Artificial Sequence
  Synthetic
caaggauggaacaagaccauggat

SEQ ID NO: 102877 - DNA, 26 bp, Artificial Sequence
  Synthetic
agttgacuaacagttgctuaaagcct

SEQ ID NO: 102878 - DNA, 22 bp, Artificial Sequence
  Synthetic
ctgactugcactctgucacact

SEQ ID NO: 102879 - DNA, 24 bp, Artificial Sequence
  Synthetic
gttacctttagcugaccccttucc

SEQ ID NO: 102880 - DNA, 26 bp, Artificial Sequence
  Synthetic
ctctccttgtuttcttctttccucct

SEQ ID NO: 102881 - DNA, 20 bp, Artificial Sequence
  Synthetic
ccagugaccccagagctuac

SEQ ID NO: 102882 - DNA, 17 bp, Artificial Sequence
  Synthetic
gtcagcucccucagcgt

SEQ ID NO: 102883 - DNA, 19 bp, Artificial Sequence
  Synthetic
gaccagcggcutcaugaga

SEQ ID NO: 102884 - DNA, 21 bp, Artificial Sequence
  Synthetic
ccgattcucctctgctcucca

SEQ ID NO: 102885 - DNA, 17 bp, Artificial Sequence
  Synthetic
gcccgcaucccgucaag

SEQ ID NO: 102886 - DNA, 21 bp, Artificial Sequence
  Synthetic
cagcucagcaggagtaaggut

SEQ ID NO: 102887 - DNA, 19 bp, Artificial Sequence
  Synthetic
ctggagugcccacagucag

SEQ ID NO: 102888 - DNA, 22 bp, Artificial Sequence
  Synthetic
gcaacucatcccucacaagcaa

SEQ ID NO: 102889 - DNA, 22 bp, Artificial Sequence
  Synthetic
aacaagccucagtgtgauggag

SEQ ID NO: 102890 - DNA, 23 bp, Artificial Sequence
  Synthetic
tgaacuccagcaaatcaguccat

SEQ ID NO: 102891 - DNA, 28 bp, Artificial Sequence
  Synthetic
cagatctggugatctatgtcuacacaaa

SEQ ID NO: 102892 - DNA, 28 bp, Artificial Sequence
  Synthetic
gggaaatgcttuctatattctgtgtuct

SEQ ID NO: 102893 - DNA, 20 bp, Artificial Sequence
  Synthetic
gggcaagcaugcugaacaat

SEQ ID NO: 102894 - DNA, 26 bp, Artificial Sequence
  Synthetic
catccacattuactctaggccttucc

SEQ ID NO: 102895 - DNA, 25 bp, Artificial Sequence
  Synthetic
gctgttcaagaacuacacttgucct

SEQ ID NO: 102896 - DNA, 23 bp, Artificial Sequence
  Synthetic
cccccatcucatcaaggagaauc

SEQ ID NO: 102897 - DNA, 26 bp, Artificial Sequence
  Synthetic
ggtaaggucaaagccctaaaatucct

SEQ ID NO: 102898 - DNA, 21 bp, Artificial Sequence
  Synthetic
gcagatccuggtgggtgtauc

SEQ ID NO: 102899 - DNA, 22 bp, Artificial Sequence
  Synthetic
acttgttugtgtgtgucaccct

SEQ ID NO: 102900 - DNA, 28 bp, Artificial Sequence
  Synthetic
cctcaaattcacauttgctcctctctua

SEQ ID NO: 102901 - DNA, 23 bp, Artificial Sequence
  Synthetic
cgtgaagcugctgaaactttucc

SEQ ID NO: 102902 - DNA, 21 bp, Artificial Sequence
  Synthetic
ccaaacacgcutccagaguct

SEQ ID NO: 102903 - DNA, 23 bp, Artificial Sequence
  Synthetic
gtagctgugaagacgttctguga

SEQ ID NO: 102904 - DNA, 23 bp, Artificial Sequence
  Synthetic
cctcgctgucataacaagauccc

SEQ ID NO: 102905 - DNA, 27 bp, Artificial Sequence
  Synthetic
ggagcaagagcacauagagattaauga

SEQ ID NO: 102906 - DNA, 20 bp, Artificial Sequence
  Synthetic
gacaagagacutcccgcugt

SEQ ID NO: 102907 - DNA, 27 bp, Artificial Sequence
  Synthetic
cctatgatuggcaaactcaagttctut

SEQ ID NO: 102908 - DNA, 28 bp, Artificial Sequence
  Synthetic
cactcattgacauctgctccttuagaaa

SEQ ID NO: 102909 - DNA, 22 bp, Artificial Sequence
  Synthetic
aaaugagcagggaggacatugt

SEQ ID NO: 102910 - DNA, 22 bp, Artificial Sequence
  Synthetic
accaugacgaagcagaagtucc

SEQ ID NO: 102911 - DNA, 28 bp, Artificial Sequence
  Synthetic
gcugattaaagctgtucaaaacgaagat

SEQ ID NO: 102912 - DNA, 22 bp, Artificial Sequence
  Synthetic
ctgttttgccaucactgtcugt

SEQ ID NO: 102913 - DNA, 21 bp, Artificial Sequence
  Synthetic
ggctatuacgcatctgcugct

SEQ ID NO: 102914 - DNA, 28 bp, Artificial Sequence
  Synthetic
cctccttctgaaguatcagcaatttugt

SEQ ID NO: 102915 - DNA, 24 bp, Artificial Sequence
  Synthetic
tcuctctcauggagccaaagaaga

SEQ ID NO: 102916 - DNA, 22 bp, Artificial Sequence
  Synthetic
gtctucagcaggagggugaaaa

SEQ ID NO: 102917 - DNA, 22 bp, Artificial Sequence
  Synthetic
aacgtggagccaguacagatug

SEQ ID NO: 102918 - DNA, 21 bp, Artificial Sequence
  Synthetic
caattgcuggaccaggucaac

SEQ ID NO: 102919 - DNA, 22 bp, Artificial Sequence
  Synthetic
agtggtagcagguggcattuac

SEQ ID NO: 102920 - DNA, 20 bp, Artificial Sequence
  Synthetic
ttgacaucagccccatgguc

SEQ ID NO: 102921 - DNA, 26 bp, Artificial Sequence
  Synthetic
gaaaaaggacacguagaggtctugaa

SEQ ID NO: 102922 - DNA, 27 bp, Artificial Sequence
  Synthetic
tttcaatgggtcauatcacagattcut

SEQ ID NO: 102923 - DNA, 21 bp, Artificial Sequence
  Synthetic
gtaagactgtugctgccagug

SEQ ID NO: 102924 - DNA, 23 bp, Artificial Sequence
  Synthetic
cttcgacaucgaggatgacauca

SEQ ID NO: 102925 - DNA, 21 bp, Artificial Sequence
  Synthetic
aagctguccttgtugcagaca

SEQ ID NO: 102926 - DNA, 28 bp, Artificial Sequence
  Synthetic
aagagagaaaucacagacauacaaagca

SEQ ID NO: 102927 - DNA, 28 bp, Artificial Sequence
  Synthetic
tttgatcatggucctatctctgtctuct

SEQ ID NO: 102928 - DNA, 23 bp, Artificial Sequence
  Synthetic
ctcacatugcccctgacaacaua

SEQ ID NO: 102929 - DNA, 28 bp, Artificial Sequence
  Synthetic
acagtaaataacacuctggtgtcatuct

SEQ ID NO: 102930 - DNA, 30 bp, Artificial Sequence
  Synthetic
aatgtaccatgtuaatgtcttcttgtucct

SEQ ID NO: 102931 - DNA, 24 bp, Artificial Sequence
  Synthetic
tggctgaccaguaaatccattcug

SEQ ID NO: 102932 - DNA, 33 bp, Artificial Sequence
  Synthetic
atctctgctattacuttactaagaatgatgaug

SEQ ID NO: 102933 - DNA, 21 bp, Artificial Sequence
  Synthetic
ccaacgcgagaaaucccugat

SEQ ID NO: 102934 - DNA, 32 bp, Artificial Sequence; identical to SEQ ID NO: 34208
  Synthetic

SEQ ID NO: 102935 - DNA, 28 bp, Artificial Sequence
  Synthetic
agctgacctagutccaatcttttcttut

SEQ ID NO: 102936 - DNA, 25 bp, Artificial Sequence
  Synthetic
tcataccttgcutaatgggtguaga

SEQ ID NO: 102937 - DNA, 25 bp, Artificial Sequence
  Synthetic
cctatcatcauaggtcgtcatgcut

SEQ ID NO: 102938 - DNA, 29 bp, Artificial Sequence
  Synthetic
aaattctgcattggugctaaaagtttcut

SEQ ID NO: 102939 - DNA, 24 bp, Artificial Sequence
  Synthetic
gcagagaaugagggaggaguacat

SEQ ID NO: 102940 - DNA, 27 bp, Artificial Sequence
  Synthetic
gtctagccagagacaucaagaatgaut

SEQ ID NO: 102941 - DNA, 27 bp, Artificial Sequence
  Synthetic
tgctaaaatgugtgatatcccuagaca

SEQ ID NO: 102942 - DNA, 31 bp, Artificial Sequence; identical to SEQ ID NO: 57612
  Synthetic

SEQ ID NO: 102943 - DNA, 22 bp, Artificial Sequence
  Synthetic
gcaaugagggaccagtacauga

SEQ ID NO: 102944 - DNA, 22 bp, Artificial Sequence
  Synthetic
ggagaaatutgccacttuggct

SEQ ID NO: 102945 - DNA, 27 bp, Artificial Sequence
  Synthetic
gcagcagacttugtggtcactaaaaug

SEQ ID NO: 102946 - DNA, 19 bp, Artificial Sequence
  Synthetic
cguggcaggaaacauccct

SEQ ID NO: 102947 - DNA, 26 bp, Artificial Sequence
  Synthetic
actgctcaaagaaacuaatcaacuga

SEQ ID NO: 102948 - DNA, 23 bp, Artificial Sequence
  Synthetic
aaaaactgtgutgtggagugcaa

SEQ ID NO: 102949 - DNA, 27 bp, Artificial Sequence
  Synthetic
cctgaacauccatttcaaaguaagcaa

SEQ ID NO: 102950 - DNA, 27 bp, Artificial Sequence
  Synthetic
tcttgattcuggaacagatttgtctut

SEQ ID NO: 102951 - DNA, 26 bp, Artificial Sequence
  Synthetic
gggattccaugattcgatgtucacat

SEQ ID NO: 102952 - DNA, 23 bp, Artificial Sequence
  Synthetic
cctatggcuttccaaccuaggaa

SEQ ID NO: 102953 - DNA, 17 bp, Artificial Sequence
  Synthetic
cagatccgugggcguga

SEQ ID NO: 102954 - DNA, 26 bp, Artificial Sequence
  Synthetic
gcattauaagccccagtgatctucca

SEQ ID NO: 102955 - DNA, 20 bp, Artificial Sequence
  Synthetic
tgcagctugcttagguccac

SEQ ID NO: 102956 - DNA, 21 bp, Artificial Sequence
  Synthetic
gctactggugatgctguccaa

SEQ ID NO: 102957 - DNA, 27 bp, Artificial Sequence
  Synthetic
ttgtattcaaggaguttgtttgtucct

SEQ ID NO: 102958 - DNA, 30 bp, Artificial Sequence
  Synthetic
ctgggaaaattaugcttactaatgtggtut

SEQ ID NO: 102959 - DNA, 24 bp, Artificial Sequence
  Synthetic
acaagcagautcaaggtgaucagt

SEQ ID NO: 102960 - DNA, 24 bp, Artificial Sequence
  Synthetic
ggaccaacugatcaccttgaauct

SEQ ID NO: 102961 - DNA, 28 bp, Artificial Sequence
  Synthetic
gcacttatgcutaaaatctattugcagt

SEQ ID NO: 102962 - DNA, 28 bp, Artificial Sequence
  Synthetic
tgtaggaaagguacaatgatttccacut

SEQ ID NO: 102963 - DNA, 27 bp, Artificial Sequence
  Synthetic
cacagatttataucatccaggcctuca

SEQ ID NO: 102964 - DNA, 26 bp, Artificial Sequence
  Synthetic
ggcctggaugatataaatctguggat

SEQ ID NO: 102965 - DNA, 32 bp, Artificial Sequence
  Synthetic
actaattaatcttcutacttcacacatuggct

SEQ ID NO: 102966 - DNA, 25 bp, Artificial Sequence
  Synthetic
tgcgaacagugaatatttccttuga

SEQ ID NO: 102967 - DNA, 27 bp, Artificial Sequence
  Synthetic
ggatctggatcauttggaacagtcuac

SEQ ID NO: 102968 - DNA, 30 bp, Artificial Sequence; identical to SEQ ID NO: 67354
  Synthetic

SEQ ID NO: 102969 - DNA, 24 bp, Artificial Sequence
  Synthetic
acctacttacugtacctggugaca

SEQ ID NO: 102970 - DNA, 25 bp, Artificial Sequence
  Synthetic
catacttaccaugccactttcccut

SEQ ID NO: 102971 - DNA, 26 bp, Artificial Sequence
  Synthetic
ttttctgtttggcutgacttgactut

SEQ ID NO: 102972 - DNA, 28 bp, Artificial Sequence
  Synthetic
gaagtgggtccuatagatttctcuacca

SEQ ID NO: 102973 - DNA, 23 bp, Artificial Sequence
  Synthetic
tcaccaatctuctaccagtgugt

SEQ ID NO: 102974 - DNA, 18 bp, Artificial Sequence
  Synthetic
ccagccuctcggguacat

SEQ ID NO: 102975 - DNA, 18 bp, Artificial Sequence
  Synthetic
ccacagcccccuguacga

SEQ ID NO: 102976 - DNA, 27 bp, Artificial Sequence
  Synthetic
tgagatcaagatugcagatacagaauc

SEQ ID NO: 102977 - DNA, 21 bp, Artificial Sequence
  Synthetic
ttcaccuttagcuggcagacc

SEQ ID NO: 102978 - DNA, 22 bp, Artificial Sequence
  Synthetic
agacagaaaagcggcugtuagt

SEQ ID NO: 102979 - DNA, 23 bp, Artificial Sequence
  Synthetic
ggtatccacaucctcttccucag

SEQ ID NO: 102980 - DNA, 33 bp, Artificial Sequence
  Synthetic
tgtatttttctttaagugcaaatagtgtatcug

SEQ ID NO: 102981 - DNA, 23 bp, Artificial Sequence
  Synthetic
cacctccugctaagcgaaatuct

SEQ ID NO: 102982 - DNA, 27 bp, Artificial Sequence
  Synthetic
ccatcttgaacauctttgtttctctuc

SEQ ID NO: 102983 - DNA, 28 bp, Artificial Sequence
  Synthetic
tgcatcactaacacuactatcaggguaa

SEQ ID NO: 102984 - DNA, 26 bp, Artificial Sequence
  Synthetic
gtgcattatugtgatgattcugacct

SEQ ID NO: 102985 - DNA, 24 bp, Artificial Sequence
  Synthetic
tctcctcaacaaccutccactgua

SEQ ID NO: 102986 - DNA, 26 bp, Artificial Sequence
  Synthetic
tccattttcttcuctctgaccttugg

SEQ ID NO: 102987 - DNA, 30 bp, Artificial Sequence
  Synthetic
atcatcgtcatucaagagaatatttuccct

SEQ ID NO: 102988 - DNA, 22 bp, Artificial Sequence
  Synthetic
gatggatacguggacccttcug

SEQ ID NO: 102989 - DNA, 29 bp, Artificial Sequence
  Synthetic
acatgggaaaacauaaccttgaauaaaag

SEQ ID NO: 102990 - DNA, 29 bp, Artificial Sequence
  Synthetic
attaaaaaccttgtuatataggcccagut

SEQ ID NO: 102991 - DNA, 21 bp, Artificial Sequence
  Synthetic
gcctgcccuagttccaagaug

SEQ ID NO: 102992 - DNA, 22 bp, Artificial Sequence
  Synthetic
gatttgggtgcutgggcctaua

SEQ ID NO: 102993 - DNA, 26 bp, Artificial Sequence
  Synthetic
agatgatgccutctccatttucagac

SEQ ID NO: 102994 - DNA, 19 bp, Artificial Sequence
  Synthetic
aggacugcccatccacuga

SEQ ID NO: 102995 - DNA, 28 bp, Artificial Sequence
  Synthetic
ccatcgcctcuttaacaatttagctaug

SEQ ID NO: 102996 - DNA, 33 bp, Artificial Sequence
  Synthetic
aatccgaattaguaatttatctaaatuggaggt

SEQ ID NO: 102997 - DNA, 27 bp, Artificial Sequence
  Synthetic
tcacggtgaacaaugtacttttgauga

SEQ ID NO: 102998 - DNA, 29 bp, Artificial Sequence
  Synthetic
aaatttuagagaagcaaaacatucaaggt

SEQ ID NO: 102999 - DNA, 23 bp, Artificial Sequence
  Synthetic
ctgtcagaugcccttcauggaaa

SEQ ID NO: 103000 - DNA, 26 bp, Artificial Sequence
  Synthetic
gcaaaacactucacggtactttcuac

SEQ ID NO: 103001 - DNA, 31 bp, Artificial Sequence
  Synthetic
atatcaaaggaatuatgtgtggattgtuaca

SEQ ID NO: 103002 - DNA, 28 bp, Artificial Sequence
  Synthetic
ttcttgttcctugcacattgatttctut

SEQ ID NO: 103003 - DNA, 33 bp, Artificial Sequence
  Synthetic
aaaaagttaaacaagugttttctgtattgtuga

SEQ ID NO: 103004 - DNA, 33 bp, Artificial Sequence
  Synthetic
atgttacatttctcuttagatgaacaaatguct

SEQ ID NO: 103005 - DNA, 28 bp, Artificial Sequence
  Synthetic
agttagtttgtgguagtagtcatgucat

SEQ ID NO: 103006 - DNA, 17 bp, Artificial Sequence
  Synthetic
ctgggcccutctgctug

SEQ ID NO: 103007 - DNA, 17 bp, Artificial Sequence
  Synthetic
cggctgcugtgcctuct

SEQ ID NO: 103008 - DNA, 27 bp, Artificial Sequence
  Synthetic
gctgactcggaguctcagtgataaaua

SEQ ID NO: 103009 - DNA, 23 bp, Artificial Sequence
  Synthetic
acattuaacgacaagcaaagcug

SEQ ID NO: 103010 - DNA, 27 bp, Artificial Sequence
  Synthetic
gcagaatgauttggacatugaagaaga

SEQ ID NO: 103011 - DNA, 25 bp, Artificial Sequence
  Synthetic
accgcaggcucaataaattatuact

SEQ ID NO: 103012 - DNA, 25 bp, Artificial Sequence
  Synthetic
ggcgaactucaggatcacagtaaut

SEQ ID NO: 103013 - DNA, 33 bp, Artificial Sequence
  Synthetic
aatgttgtatattaccautggctaaattttuga

SEQ ID NO: 103014 - DNA, 20 bp, Artificial Sequence
  Synthetic
ctcaggccgaugcttgaauc

SEQ ID NO: 103015 - DNA, 29 bp, Artificial Sequence
  Synthetic
actactagtaaccugatatacactgctut

SEQ ID NO: 103016 - DNA, 27 bp, Artificial Sequence
  Synthetic
gctcccactgutgatttatctgauagt

SEQ ID NO: 103017 - DNA, 33 bp, Artificial Sequence
  Synthetic
aaaaatatgtacgucaatattcacaugaagaaa

SEQ ID NO: 103018 - DNA, 22 bp, Artificial Sequence
  Synthetic
tcccggacucaaaatcctcuca

SEQ ID NO: 103019 - DNA, 28 bp, Artificial Sequence
  Synthetic
ccatgaataagcaugtcttcacatttut

SEQ ID NO: 103020 - DNA, 26 bp, Artificial Sequence
  Synthetic
ccttcacttugttttgagggauccaa

SEQ ID NO: 103021 - DNA, 31 bp, Artificial Sequence
  Synthetic
gtgctgtaagtatutcaaaagtacgtttuca

SEQ ID NO: 103022 - DNA, 33 bp, Artificial Sequence
  Synthetic
attgttttctctuagatatgcaataatttuccc

SEQ ID NO: 103023 - DNA, 28 bp, Artificial Sequence
  Synthetic
tccatcgattctuggtgttcttttacut

SEQ ID NO: 103024 - DNA, 28 bp, Artificial Sequence
  Synthetic
aattgtttccaaucatttagctucaccc

SEQ ID NO: 103025 - DNA, 28 bp, Artificial Sequence
  Synthetic
ggtgcttacaaucctgatgttttcatuc

SEQ ID NO: 103026 - DNA, 21 bp, Artificial Sequence
  Synthetic
ggaaacccaucgccugagaaa

SEQ ID NO: 103027 - DNA, 25 bp, Artificial Sequence
  Synthetic
gcaaagtgatugactgtgacagtuc

SEQ ID NO: 103028 - DNA, 23 bp, Artificial Sequence
  Synthetic
acaugttttcctcucgaaagcca

SEQ ID NO: 103029 - DNA, 26 bp, Artificial Sequence
  Synthetic
ggacaauggaaaggctgttataugga

SEQ ID NO: 103030 - DNA, 21 bp, Artificial Sequence
  Synthetic
tttcagggcugcaaccaagua

SEQ ID NO: 103031 - DNA, 21 bp, Artificial Sequence
  Synthetic
gggtcctgucaccgtaagaug

SEQ ID NO: 103032 - DNA, 21 bp, Artificial Sequence
  Synthetic
cttaggcaaggutgggtguga

SEQ ID NO: 103033 - DNA, 27 bp, Artificial Sequence
  Synthetic
catccaaagacuttttgccacttguag

SEQ ID NO: 103034 - DNA, 22 bp, Artificial Sequence
  Synthetic
gcaatattuggcaccactggut

SEQ ID NO: 103035 - DNA, 28 bp, Artificial Sequence
  Synthetic
tgtatcaactguggtaaatgctacauga

SEQ ID NO: 103036 - DNA, 21 bp, Artificial Sequence
  Synthetic
tctgaacagcutgccuaaccc

SEQ ID NO: 103037 - DNA, 28 bp, Artificial Sequence
  Synthetic
tcatgtagctcautgtcaagttggatut

SEQ ID NO: 103038 - DNA, 28 bp, Artificial Sequence
  Synthetic
ctactgtattattuctcatggcagcuct

SEQ ID NO: 103039 - DNA, 28 bp, Artificial Sequence
  Synthetic
gattgctagcautatgtgcagtuacaat

SEQ ID NO: 103040 - DNA, 23 bp, Artificial Sequence
  Synthetic
tgtttcaacautgagagcugggt

SEQ ID NO: 103041 - DNA, 27 bp, Artificial Sequence
  Synthetic
tgtataaguagagctgggttuggaact

SEQ ID NO: 103042 - DNA, 25 bp, Artificial Sequence
  Synthetic
cttggtgucaggcgaattaaagtut

SEQ ID NO: 103043 - DNA, 26 bp, Artificial Sequence
  Synthetic
ccaggaacctguacctttaatgtcug

SEQ ID NO: 103044 - DNA, 26 bp, Artificial Sequence
  Synthetic
ggctcacccugtagatcagagaauaa

SEQ ID NO: 103045 - DNA, 25 bp, Artificial Sequence
  Synthetic
accttctaccuctttcctgcttuag

SEQ ID NO: 103046 - DNA, 32 bp, Artificial Sequence; identical to SEQ ID NO: 55978
  Synthetic

SEQ ID NO: 103047 - DNA, 23 bp, Artificial Sequence
  Synthetic
cutccauaagaacggagggacat

SEQ ID NO: 103048 - DNA, 26 bp, Artificial Sequence
  Synthetic
atattctctguaagaatggcccuagt

SEQ ID NO: 103049 - DNA, 28 bp, Artificial Sequence
  Synthetic
acgggaaaagaacugtggttaaatauga

SEQ ID NO: 103050 - DNA, 20 bp, Artificial Sequence
  Synthetic
accacaucaccugcaaccat

SEQ ID NO: 103051 - DNA, 21 bp, Artificial Sequence
  Synthetic
ctggaagugcctcctcttcug

SEQ ID NO: 103052 - DNA, 23 bp, Artificial Sequence
  Synthetic
gctccacatcuccatggatacuc

SEQ ID NO: 103053 - DNA, 26 bp, Artificial Sequence
  Synthetic
gccttagtaaguccacacttuaagca

SEQ ID NO: 103054 - DNA, 26 bp, Artificial Sequence
  Synthetic
cgaacataugaacacgaagcaatgug

SEQ ID NO: 103055 - DNA, 28 bp, Artificial Sequence
  Synthetic
ccaacatactgaaauaacctcagcacua

SEQ ID NO: 103056 - DNA, 25 bp, Artificial Sequence
  Synthetic
ggctttgacaaacutgactttugga

SEQ ID NO: 103057 - DNA, 28 bp, Artificial Sequence
  Synthetic
gtgaagcacagguttttatcagtcatug

SEQ ID NO: 103058 - DNA, 22 bp, Artificial Sequence
  Synthetic
agctauccaggataugccacct

SEQ ID NO: 103059 - DNA, 23 bp, Artificial Sequence
  Synthetic
aacaccggacaagaguttcugaa

SEQ ID NO: 103060 - DNA, 18 bp, Artificial Sequence
  Synthetic
ggaggaccuggaccgugt

SEQ ID NO: 103061 - DNA, 17 bp, Artificial Sequence
  Synthetic
cgcacagccaccucugt

SEQ ID NO: 103062 - DNA, 28 bp, Artificial Sequence
  Synthetic
agtgaaaaacaatuccctgaaagcuaga

SEQ ID NO: 103063 - DNA, 21 bp, Artificial Sequence
  Synthetic
atctgaaagccgaugtgguca

SEQ ID NO: 103064 - DNA, 23 bp, Artificial Sequence
  Synthetic
atccatgcauctccttgccuaag

SEQ ID NO: 103065 - DNA, 28 bp, Artificial Sequence
  Synthetic
gcagatgcccuggagttaaatttaucat

SEQ ID NO: 103066 - DNA, 26 bp, Artificial Sequence
  Synthetic
ccggttaugcacatcatttaaguagg

SEQ ID NO: 103067 - DNA, 28 bp, Artificial Sequence
  Synthetic
tctatcaccaaguccaagtatguaacca

SEQ ID NO: 103068 - DNA, 20 bp, Artificial Sequence
  Synthetic
tggttccccggaugattcug

SEQ ID NO: 103069 - DNA, 28 bp, Artificial Sequence
  Synthetic
aaaattcctcugcaaaaatgugagaagg

SEQ ID NO: 103070 - DNA, 27 bp, Artificial Sequence
  Synthetic
ttctctctcuccaatagaaguggaaca

SEQ ID NO: 103071 - DNA, 27 bp, Artificial Sequence
  Synthetic
tgaagtugagcagcagaagtaguaaat

SEQ ID NO: 103072 - DNA, 17 bp, Artificial Sequence
  Synthetic
acgcggagcugcguaag

SEQ ID NO: 103073 - DNA, 18 bp, Artificial Sequence
  Synthetic
ccaccgaggcugaggaug

SEQ ID NO: 103074 - DNA, 27 bp, Artificial Sequence
  Synthetic
cgtaagtaaccucatgctttcugaagt

SEQ ID NO: 103075 - DNA, 24 bp, Artificial Sequence
  Synthetic
tcactgtgtugttgtacggaaugt

SEQ ID NO: 103076 - DNA, 17 bp, Artificial Sequence
  Synthetic
ccgcggutccctagcuc

SEQ ID NO: 103077 - DNA, 18 bp, Artificial Sequence
  Synthetic
acacacgguccacagcuc

SEQ ID NO: 103078 - DNA, 18 bp, Artificial Sequence
  Synthetic
gcagactugcggcagtut

SEQ ID NO: 103079 - DNA, 17 bp, Artificial Sequence
  Synthetic
agcucgaggcgtucagg

SEQ ID NO: 103080 - DNA, 22 bp, Artificial Sequence
  Synthetic
cttgggugggtagagcaaucag

SEQ ID NO: 103081 - DNA, 19 bp, Artificial Sequence
  Synthetic
gataccccgugggcaagut

SEQ ID NO: 103082 - DNA, 23 bp, Artificial Sequence
  Synthetic
ctgcttccaggugtcatatugga

SEQ ID NO: 103083 - DNA, 24 bp, Artificial Sequence
  Synthetic
gtggacatuagctcaagtcacuga

SEQ ID NO: 103084 - DNA, 22 bp, Artificial Sequence
  Synthetic
ccgaagcccuatttctctguct

SEQ ID NO: 103085 - DNA, 21 bp, Artificial Sequence
  Synthetic
tcgttgaggagugctgttucc

SEQ ID NO: 103086 - DNA, 21 bp, Artificial Sequence
  Synthetic
gggtagcacaguacgtcucca

SEQ ID NO: 103087 - DNA, 20 bp, Artificial Sequence
  Synthetic
gtgcuaacacggctctcuct

SEQ ID NO: 103088 - DNA, 20 bp, Artificial Sequence
  Synthetic
cgtccucaccggtcactcua

SEQ ID NO: 103089 - DNA, 20 bp, Artificial Sequence
  Synthetic
gtgctgcautgctgctuacc

SEQ ID NO: 103090 - DNA, 18 bp, Artificial Sequence
  Synthetic
cgcacaggguctcacugg

SEQ ID NO: 103091 - DNA, 17 bp, Artificial Sequence
  Synthetic
ccgcucacgccactuct

SEQ ID NO: 103092 - DNA, 27 bp, Artificial Sequence
  Synthetic
tgattgggtttuggcattttcaauaca

SEQ ID NO: 103093 - DNA, 28 bp, Artificial Sequence
  Synthetic
ggagactaaagucagacagtgaagatut

SEQ ID NO: 103094 - DNA, 21 bp, Artificial Sequence
  Synthetic
cgggaaacacagcucaaaucc

SEQ ID NO: 103095 - DNA, 21 bp, Artificial Sequence
  Synthetic
tcuatgcaaguccaacgcact

SEQ ID NO: 103096 - DNA, 22 bp, Artificial Sequence
  Synthetic
ggataatggtuaccccgtccuc

SEQ ID NO: 103097 - DNA, 27 bp, Artificial Sequence
  Synthetic
agtgctttctuacatcgttcaaacuct

SEQ ID NO: 103098 - DNA, 25 bp, Artificial Sequence
  Synthetic
agagataatgutgctgtcauggcaa

SEQ ID NO: 103099 - DNA, 28 bp, Artificial Sequence
  Synthetic
catctgttctttgutcactctcttcuat

SEQ ID NO: 103100 - DNA, 27 bp, Artificial Sequence
  Synthetic
tttcaatgggtcauatcacagattcut

SEQ ID NO: 103101 - DNA, 23 bp, Artificial Sequence
  Synthetic
ttcctcaggautgccttuaccac

SEQ ID NO: 103102 - DNA, 33 bp, Artificial Sequence; identical to SEQ ID NO: 496
  Synthetic

SEQ ID NO: 103103 - DNA, 27 bp, Artificial Sequence
  Synthetic
cacgctctauactgcaaatgctaucga

SEQ ID NO: 103104 - DNA, 28 bp, Artificial Sequence
  Synthetic
gaaguacccagattugacaaagaaaacc

SEQ ID NO: 103105 - DNA, 28 bp, Artificial Sequence
  Synthetic
cacaagtcagtguctttatccaaatguc

SEQ ID NO: 103106 - DNA, 28 bp, Artificial Sequence
  Synthetic
caatttttaatgaugctttctggcugga

SEQ ID NO: 103107 - DNA, 30 bp, Artificial Sequence; identical to SEQ ID NO: 461
  Synthetic

SEQ ID NO: 103108 - DNA, 32 bp, Artificial Sequence; identical to SEQ ID NO: 403
  Synthetic

SEQ ID NO: 103109 - DNA, 33 bp, Artificial Sequence; identical to SEQ ID NO: 404
  Synthetic

SEQ ID NO: 103110 - DNA, 33 bp, Artificial Sequence; identical to SEQ ID NO: 319
  Synthetic

SEQ ID NO: 103111 - DNA, 28 bp, Artificial Sequence
  Synthetic
gctgaagagugcaaacaatacatcauac

SEQ ID NO: 103112 - DNA, 22 bp, Artificial Sequence
  Synthetic
tgagtuccaaggcctcatucag

SEQ ID NO: 103113 - DNA, 28 bp, Artificial Sequence
  Synthetic
tgaaccatctttuaactcaggtactgug

SEQ ID NO: 103114 - DNA, 26 bp, Artificial Sequence
  Synthetic
gggaagaaaagugttttgaaatgugt

SEQ ID NO: 103115 - DNA, 27 bp, Artificial Sequence
  Synthetic
caaacaagttuatatttccccaugcca

SEQ ID NO: 103116 - DNA, 26 bp, Artificial Sequence
  Synthetic
tgggactttgguaattcaccagtuac

SEQ ID NO: 103117 - DNA, 28 bp, Artificial Sequence
  Synthetic
ctgcatcggguccacataaatatatuca

SEQ ID NO: 103118 - DNA, 25 bp, Artificial Sequence
  Synthetic
ctauttttccctttcuccccacaga

SEQ ID NO: 103119 - DNA, 23 bp, Artificial Sequence
  Synthetic
tgaccaaaacucagcctgttuct

SEQ ID NO: 103120 - DNA, 21 bp, Artificial Sequence
  Synthetic
ccagauagcccuggacaaacc

SEQ ID NO: 103121 - DNA, 24 bp, Artificial Sequence
  Synthetic
cagcatttacugcagcttgctuag

SEQ ID NO: 103122 - DNA, 24 bp, Artificial Sequence
  Synthetic
  misc_feature (1)..(24): any n is inosine
cctgcaantaatttnaagagttnt

SEQ ID NO: 103123 - DNA, 28 bp, Artificial Sequence
  Synthetic
  misc_feature (1)..(28): any n is inosine
tggcaacnacattcanttatttaattng

SEQ ID NO: 103124 - DNA, 20 bp, Artificial Sequence
  Synthetic
  misc_feature (1)..(20): any n is inosine
gaaggntgttgangcaacng

SEQ ID NO: 103125 - DNA, 21 bp, Artificial Sequence
  Synthetic
  misc_feature (1)..(21): any n is inosine
acaacnggcaaacngatgnca

SEQ ID NO: 103126 - DNA, 26 bp, Artificial Sequence
  Synthetic
  misc_feature (1)..(26): any n is inosine
gactgtancctgganattattcttnt

SEQ ID NO: 103127 - DNA, 25 bp, Artificial Sequence
  Synthetic
  misc_feature (1)..(25): any n is inosine
tctntcaanacaacacacaaacnct

SEQ ID NO: 103128 - DNA, 24 bp, Artificial Sequence
  Synthetic
  misc_feature (1)..(24): any n is inosine
atgatnctggagtnttcatgtgnt

SEQ ID NO: 103129 - DNA, 25 bp, Artificial Sequence
  Synthetic
  misc_feature (1)..(25): any n is inosine
tcttctntcactacngccagtaant

SEQ ID NO: 103130 - DNA, 25 bp, Artificial Sequence
  Synthetic
  misc_feature (1)..(25): any n is inosine
gcataanaataggnatagcttccng

SEQ ID NO: 103131 - DNA, 25 bp, Artificial Sequence
  Synthetic
  misc_feature (1)..(25): any n is inosine
tgatanacagcaacanctctcttng

SEQ ID NO: 103132 - DNA, 24 bp, Artificial Sequence
  Synthetic
  misc_feature (1)..(24): any n is inosine
acatcanctacagtncctcatgna

SEQ ID NO: 103133 - DNA, 15 bp, Artificial Sequence
  Synthetic
  misc_feature (1)..(15): any n is inosine
gcgnggtnccanccc

SEQ ID NO: 103134 - DNA, 22 bp, Artificial Sequence
  Synthetic
  misc_feature (1)..(22): any n is inosine
aaagaanggcagacngacagnt

SEQ ID NO: 103135 - DNA, 24 bp, Artificial Sequence
  Synthetic
  misc_feature (1)..(24): any n is inosine
tgactnattttnaccaagagtnca

SEQ ID NO: 103136 - DNA, 25 bp, Artificial Sequence
  Synthetic
  misc_feature (1)..(25): any n is inosine
tctgtttnatgtttncattcttgng

SEQ ID NO: 103137 - DNA, 20 bp, Artificial Sequence
  Synthetic
  misc_feature (1)..(20): any n is inosine
gaacantctggntggaatng

SEQ ID NO: 103138 - DNA, 21 bp, Artificial Sequence
  Synthetic
  misc_feature (1)..(21): any n is inosine
ttcaagngagtggnagcagna

SEQ ID NO: 103139 - DNA, 28 bp, Artificial Sequence
  Synthetic
  misc_feature (1)..(28): any n is inosine
ttttaaaaaanttctctcntatgcttnc

SEQ ID NO: 103140 - DNA, 21 bp, Artificial Sequence
  Synthetic
  misc_feature (1)..(21): any n is inosine
gcagncgttcacaangtncat

SEQ ID NO: 103141 - DNA, 20 bp, Artificial Sequence
  Synthetic
  misc_feature (1)..(30): any n is inosine
aacanccaaacaacagtgng

SEQ ID NO: 103142 - DNA, 24 bp, Artificial Sequence
  Synthetic
  misc_feature (1)..(24): any n is inosine
acaagaantagccanaagaacang

SEQ ID NO: 103143 - DNA, 26 bp, Artificial Sequence
  Synthetic
  misc_feature (1)..(26): any n is inosine
aaaagnataagttnccaactgttnat

SEQ ID NO: 103144 - DNA, 33 bp, Artificial Sequence
  Synthetic
taagacagtaagttgttccaataatttcaatat

SEQ ID NO: 103145 - DNA, 13 bp, Artificial Sequence
  Synthetic
taagacagtaagt

SEQ ID NO: 103146 - DNA, 24 bp, Artificial Sequence
  Synthetic
taagacagtaagttgtttcaataa

SEQ ID NO: 103147 - DNA, 23 bp, Artificial Sequence
  Synthetic
taagacagtaagttgtttcaata

SEQ ID NO: 103148 - DNA, 17 bp, Artificial Sequence
  Synthetic
taagacagtaagttgtt

SEQ ID NO: 103149 - DNA, 28 bp, Artificial Sequence
  Synthetic
taagacagtaagttgttccaataatttc

SEQ ID NO: 103150 - DNA, 28 bp, Artificial Sequence
  Synthetic
cagtaagttgttccaataatttcaatat

SEQ ID NO: 103151 - DNA, 18 bp, Artificial Sequence
  Synthetic
tttcaataatttcaatat

SEQ ID NO: 103152 - DNA, 14 bp, Artificial Sequence
  Synthetic
aataatttcaatat

SEQ ID NO: 103153 - DNA, 13 bp, Artificial Sequence
  Synthetic
ataatttcaatat

SEQ ID NO: 103154 - DNA, 10 bp, Artificial Sequence
  Synthetic
atttcaatat

SEQ ID NO: 103155 - DNA, 27 bp, Artificial Sequence
  Synthetic
gtctaagccccagattgctgctctgaa

SEQ ID NO: 103156 - DNA, 10 bp, Artificial Sequence
  Synthetic
gtctaagccc

SEQ ID NO: 103157 - DNA, 18 bp, Artificial Sequence
  Synthetic
gtctaagccccagattgc

SEQ ID NO: 103158 - DNA, 20 bp, Artificial Sequence
  Synthetic
gtctaagccccagattgctg

SEQ ID NO: 103159 - DNA, 23 bp, Artificial Sequence
  Synthetic
gtctaagccccagattgctgctc

SEQ ID NO: 103160 - DNA, 25 bp, Artificial Sequence
  Synthetic
gtctaagccccaaattgctgctctg

SEQ ID NO: 103161 - DNA, 24 bp, Artificial Sequence
  Synthetic
gtctaagccccagattgctgctct

SEQ ID NO: 103162 - DNA, 25 bp, Artificial Sequence
  Synthetic
gtctaagccccagattgctgctctg

SEQ ID NO: 103163 - DNA, 27 bp, Artificial Sequence
  Synthetic
gtctaagccccaaattgctgctctgaa

SEQ ID NO: 103164 - DNA, 26 bp, Artificial Sequence
  Synthetic
tctaagccccaaattgctgctctgaa

SEQ ID NO: 103165 - DNA, 19 bp, Artificial Sequence
  Synthetic
cccagattgctgctctgaa

SEQ ID NO: 103166 - DNA, 16 bp, Artificial Sequence
  Synthetic
aaattgctgctctgaa

SEQ ID NO: 103167 - DNA, 13 bp, Artificial Sequence
  Synthetic
ttgctgctctgaa

SEQ ID NO: 103168 - DNA, 12 bp, Artificial Sequence
  Synthetic
tgctgctctgaa

SEQ ID NO: 103169 - DNA, 10 bp, Artificial Sequence
  Synthetic
ctgctctgaa

SEQ ID NO: 103170 - DNA, 44 bp, Artificial Sequence
  Synthetic
caccattaaagaaaatatcatctttggtgtttcctatgatgaat

SEQ ID NO: 103171 - DNA, 18 bp, Artificial Sequence
  Synthetic
caccattaaagaaaatat

SEQ ID NO: 103172 - DNA, 21 bp, Artificial Sequence
  Synthetic
caccattaaagaaaatatcat

SEQ ID NO: 103173 - DNA, 28 bp, Artificial Sequence
  Synthetic
caccattaaagaaaatatcatctttggt

SEQ ID NO: 103174 - DNA, 32 bp, Artificial Sequence
  Synthetic
caccattaaagaaaatatcattggtgtttcct

SEQ ID NO: 103175 - DNA, 23 bp, Artificial Sequence
  Synthetic
caccattaaagaaaatatcattg

SEQ ID NO: 103176 - DNA, 37 bp, Artificial Sequence
  Synthetic
caccattaaagaaaatatcattggtgtttcctatgat

SEQ ID NO: 103177 - DNA, 37 bp, Artificial Sequence
  Synthetic
cattaaagaaaatatcattggtgtttcctatgatgaa

SEQ ID NO: 103178 - DNA, 38 bp, Artificial Sequence
  Synthetic
ttaaagaaaatatcatctttggtgtttcctatgatgaa

SEQ ID NO: 103179 - DNA, 29 bp, Artificial Sequence
  Synthetic
aaatatcattggtgtttcctatgatgaat

SEQ ID NO: 103180 - DNA, 29 bp, Artificial Sequence
  Synthetic
tatcatctttggtgtttcctatgatgaat

SEQ ID NO: 103181 - DNA, 26 bp, Artificial Sequence
  Synthetic
tatcattggtgtttcctatgatgaat

SEQ ID NO: 103182 - DNA, 28 bp, Artificial Sequence
  Synthetic
atcatctttggtgtttcctatgatgaat

SEQ ID NO: 103183 - DNA, 14 bp, Artificial Sequence
  Synthetic
ttcctatgatgaat

SEQ ID NO: 103184 - DNA, 27 bp, Artificial Sequence
  Synthetic
cgatatattactgtccacaagagctta

SEQ ID NO: 103185 - DNA, 15 bp, Artificial Sequence
  Synthetic
cgatatattactgtc

SEQ ID NO: 103186 - DNA, 10 bp, Artificial Sequence
  Synthetic
cgatatatta

SEQ ID NO: 103187 - DNA, 20 bp, Artificial Sequence
  Synthetic
cgatatattactgtccacaa

SEQ ID NO: 103188 - DNA, 19 bp, Artificial Sequence
  Synthetic
cgatatattacggtccaca

SEQ ID NO: 103189 - DNA, 13 bp, Artificial Sequence
  Synthetic
cgatatattactg

SEQ ID NO: 103190 - DNA, 23 bp, Artificial Sequence
  Synthetic
cgatatattacggtccacaagag

SEQ ID NO: 103191 - DNA, 16 bp, Artificial Sequence
  Synthetic
cgatatattactgtcc

SEQ ID NO: 103192 - DNA, 25 bp, Artificial Sequence
  Synthetic
cgatatattactgtccacaagagct

SEQ ID NO: 103193 - DNA, 15 bp, Artificial Sequence
  Synthetic
cgatatattacggtc

SEQ ID NO: 103194 - DNA, 27 bp, Artificial Sequence
  Synthetic
cgatatattacggtccacaagagctta

SEQ ID NO: 103195 - DNA, 24 bp, Artificial Sequence
  Synthetic
cgatatattactgtccacaagagc

SEQ ID NO: 103196 - DNA, 19 bp, Artificial Sequence
  Synthetic
tactgtccacaagagctta

SEQ ID NO: 103197 - DNA, 26 bp, Artificial Sequence
  Synthetic
tcacttctaatggtgattatgggaga

SEQ ID NO: 103198 - DNA, 17 bp, Artificial Sequence
  Synthetic
tcacttctaatgatgat

SEQ ID NO: 103199 - DNA, 25 bp, Artificial Sequence
  Synthetic
tcacttctaatgagattatgggaga

SEQ ID NO: 103200 - DNA, 26 bp, Artificial Sequence
  Synthetic
tcacttctaatgatgattatgggaga

SEQ ID NO: 103201 - DNA, 12 bp, Artificial Sequence
  Synthetic
tcacttctaatg

SEQ ID NO: 103202 - DNA, 25 bp, Artificial Sequence
  Synthetic
cacttctaatgatgattatgggaga

SEQ ID NO: 103203 - DNA, 23 bp, Artificial Sequence
  Synthetic
cttctaatgatgattatgggaga

SEQ ID NO: 103204 - DNA, 21 bp, Artificial Sequence
  Synthetic
tctaatgatgattatgggaga

SEQ ID NO: 103205 - DNA, 15 bp, Artificial Sequence
  Synthetic
gatgattatgggaga

SEQ ID NO: 103206 - DNA, 13 bp, Artificial Sequence
  Synthetic
tgattatgggaga

SEQ ID NO: 103207 - DNA, 11 bp, Artificial Sequence
  Synthetic
attatgggaga

SEQ ID NO: 103208 - DNA, 34 bp, Artificial Sequence
  Synthetic
ggaccccagcgcccgagagaccatgcagaggtcc

SEQ ID NO: 103209 - DNA, 24 bp, Artificial Sequence
  Synthetic
ggaccccagcgcccgagagaccat

SEQ ID NO: 103210 - DNA, 18 bp, Artificial Sequence
  Synthetic
ggaccccagcgcccgaga

SEQ ID NO: 103211 - DNA, 22 bp, Artificial Sequence
  Synthetic
ggaccccagcgccccagagacc

SEQ ID NO: 103212 - DNA, 22 bp, Artificial Sequence
  Synthetic
cccagagaccatgcagaggtcc

SEQ ID NO: 103213 - DNA, 12 bp, Artificial Sequence
  Synthetic
atgcagaggtcc
